US011332746B1

(12) United States Patent
Freier

(10) Patent No.: US 11,332,746 B1
(45) Date of Patent: May 17, 2022

(54) COMPOUNDS AND METHODS FOR REDUCING LRRK2 EXPRESSION

(71) Applicant: Ionis Pharmaceuticals, Inc., Carlsbad, CA (US)

(72) Inventor: Susan M. Freier, San Diego, CA (US)

(73) Assignee: Ionis Pharmaceuticals, Inc., Carlsbad, CA (US)

(*) Notice: Subject to any disclaimer, the term of this patent is extended or adjusted under 35 U.S.C. 154(b) by 0 days.

(21) Appl. No.: 16/972,822

(22) PCT Filed: Jun. 27, 2019

(86) PCT No.: PCT/US2019/039558
§ 371 (c)(1),
(2) Date: Dec. 7, 2020

(87) PCT Pub. No.: WO2020/006267
PCT Pub. Date: Jan. 2, 2020

Related U.S. Application Data

(60) Provisional application No. 62/690,790, filed on Jun. 27, 2018.

(51) Int. Cl.
| C12N 15/11 | (2006.01) |
| C12N 15/113 | (2010.01) |
| A61K 47/02 | (2006.01) |
| A61K 47/46 | (2006.01) |
| A61K 31/7125 | (2006.01) |
| A61P 25/16 | (2006.01) |

(52) U.S. Cl.
CPC ...... *C12N 15/1137* (2013.01); *A61K 31/7125* (2013.01); *A61K 47/02* (2013.01); *A61K 47/46* (2013.01); *A61P 25/16* (2018.01); *C12N 2310/11* (2013.01); *C12N 2310/315* (2013.01); *C12N 2310/321* (2013.01); *C12N 2310/3341* (2013.01); *C12N 2310/341* (2013.01); *C12N 2310/346* (2013.01); *C12N 2310/3525* (2013.01)

(58) Field of Classification Search
None
See application file for complete search history.

(56) References Cited

U.S. PATENT DOCUMENTS

| 3,687,808 | A | 8/1972 | Merigan et al. |
| 4,415,732 | A | 11/1983 | Caruthers et al. |
| 4,469,863 | A | 9/1984 | Ts'o et al. |
| 4,476,301 | A | 10/1984 | Imbach et al. |
| 4,500,707 | A | 2/1985 | Caruthers et al. |
| 4,725,677 | A | 2/1988 | Koster et al. |
| 4,845,205 | A | 7/1989 | Huynh Dinh et al. |
| 4,973,679 | A | 11/1990 | Caruthers et al. |
| 4,981,957 | A | 1/1991 | Lebleu et al. |
| 5,013,830 | A | 5/1991 | Ohutsuka et al. |
| 5,023,243 | A | 6/1991 | Tullis |
| 5,034,506 | A | 7/1991 | Summerton et al. |
| 5,118,800 | A | 6/1992 | Smith et al. |
| 5,130,302 | A | 7/1992 | Spielvogel et al. |
| 5,132,418 | A | 7/1992 | Caruthers et al. |
| 5,134,066 | A | 7/1992 | Rogers et al. |
| RE34,036 | E | 8/1992 | McGeehan |
| 5,149,797 | A | 9/1992 | Pederson et al. |
| 5,166,315 | A | 11/1992 | Summerton et al. |
| 5,175,273 | A | 12/1992 | Bischofberger et al. |
| 5,177,196 | A | 1/1993 | Meyer, Jr. et al. |
| 5,177,198 | A | 1/1993 | Spielvogel et al. |
| 5,188,897 | A | 2/1993 | Suhadolnik et al. |
| 5,194,599 | A | 3/1993 | Froehler et al. |
| 5,214,134 | A | 5/1993 | Weis et al. |
| 5,216,141 | A | 6/1993 | Benner |
| 5,220,007 | A | 6/1993 | Pederson et al. |
| 5,223,618 | A | 6/1993 | Cook et al. |
| 5,235,033 | A | 8/1993 | Summerton et al. |
| 5,256,775 | A | 10/1993 | Froehler |
| 5,264,423 | A | 11/1993 | Cohen et al. |
| 5,264,562 | A | 11/1993 | Matteucci |
| 5,264,564 | A | 11/1993 | Matteucci |
| 5,185,444 | A | 12/1993 | Summerton et al. |
| 5,276,019 | A | 1/1994 | Cohen et al. |
| 5,286,717 | A | 2/1994 | Cohen et al. |
| 5,319,080 | A | 6/1994 | Leumann |
| 5,321,131 | A | 6/1994 | Agrawal et al. |

(Continued)

FOREIGN PATENT DOCUMENTS

| WO | WO 2004/094636 | 11/2004 |
| WO | WO 2006/045392 | 5/2006 |

(Continued)

OTHER PUBLICATIONS

Alegre-Abarrategui et al., LRRK2 regulates autophagic activity and localizes to specific membrane microdomains in a novel human genomic reporter cellular model: Hum Mol Genet (2009) 18(21): 4022-4034.

Atashrazm et al. "LRRK2 Inhibitors and Their Potential in the Treatment of Parkinson's Disease: Current Perspectives" Clin Pharmacol (2016) 177-189.

Bieri et al., "LRRK2 modifies α-syn pathology and spread in mouse models and human neurons" Gitler Lab (2019) 1-41.

Branch et al., "A good antisense molecule is hard to find," TIBS (1998) 23:45-50.

(Continued)

*Primary Examiner* — Ekaterina Poliakova-Georgantas
(74) *Attorney, Agent, or Firm* — McNeill Baur PLLC

(57) ABSTRACT

Provided are compounds, methods, and pharmaceutical compositions for reducing the amount or activity of LRRK2 RNA in a cell or animal, and in certain instances reducing the amount of LRRK2 protein in a cell or animal Such compounds, methods, and pharmaceutical compositions are useful to ameliorate at least 5 one symptom or hallmark of a neurodegenerative disease. Such symptoms and hallmarks include ataxia, neuropathy, and aggregate formation. Such neurodegenerative diseases include Parkinson's disease.

26 Claims, No Drawings

Specification includes a Sequence Listing.

(56) References Cited

U.S. PATENT DOCUMENTS

| | | |
|---|---|---|
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,770,748 B2 | 8/2004 | Imanishi et al. |
| 7,015,315 B1 | 3/2006 | Cook et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,029,986 B2 | 10/2011 | Meitinger et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,187,811 B2 | 5/2012 | Ericksson et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,669,048 B2 | 3/2014 | Reijo Pera et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 9,840,710 B2 | 12/2017 | Hastings et al. |
| 10,907,160 B2 | 2/2021 | Zhao et al. |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0171570 A1 | 9/2004 | Allerson et al. |
| 2005/0130923 A1 | 6/2005 | Bhat et al. |
| 2006/0148740 A1 | 7/2006 | Platenburg |
| 2007/0031844 A1 | 2/2007 | Khvorova et al. |
| 2008/0039618 A1 | 2/2008 | Allerson et al. |
| 2010/0190837 A1 | 7/2010 | Migawa et al. |
| 2010/0197762 A1 | 8/2010 | Swayze et al. |

(56) References Cited

U.S. PATENT DOCUMENTS

| | | | |
|---|---|---|---|
| 2012/0135941 | A1 | 5/2012 | Collard et al. |
| 2013/0130378 | A1 | 5/2013 | Manoharan et al. |
| 2014/0107330 | A1 | 4/2014 | Freier et al. |
| 2014/0128322 | A1 | 5/2014 | Chen et al. |
| 2015/0018540 | A1 | 1/2015 | Prakash et al. |
| 2015/0184153 | A1 | 7/2015 | Freier et al. |
| 2015/0191727 | A1 | 7/2015 | Migawa et al. |
| 2015/0267195 | A1 | 9/2015 | Seth et al. |
| 2015/0275212 | A1 | 10/2015 | Albaek et al. |
| 2012/0052487 | A9 | 11/2015 | Khvorova et al. |
| 2017/0137826 | A1 | 5/2017 | Hastings et al. |
| 2018/0362988 | A1 | 12/2018 | Zhao et al. |
| 2021/0340546 | A1 | 11/2021 | Zhao et al. |

FOREIGN PATENT DOCUMENTS

| | | |
|---|---|---|
| WO | WO 2007/124096 | 11/2007 |
| WO | WO 2008/091799 | 7/2008 |
| WO | WO 2009/099991 | 8/2009 |
| WO | WO 2011/114106 | 9/2011 |
| WO | WO 2013/173635 | 11/2013 |
| WO | WO 2016/097212 | 6/2016 |
| WO | WO 2012/131365 | 3/2017 |
| WO | WO 2017/087282 | 5/2017 |
| WO | WO 2017/120365 | 7/2017 |
| WO | WO 2019/118325 | 6/2019 |
| WO | WO 2020/006267 | 1/2020 |

OTHER PUBLICATIONS

Chan et al., "Rac1 protein rescues neurite retraction caused by G2019S leucine-rich repeat kinase 2 (LRRK2)." J Biol Chem (2011) 286(18):16104-9.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Cho et al., "Leucine-rich repeat kinase 2 regulates Sec16A at ER exit sites to allow ER-Golgi export" EMBO J (2014) 33: 2314-2331.

Crooke et al., "Basic Principles of Antisense Therapeutics" Antisense Research and Application (1998) Chapter 1:1-50.

Crooke, ST., et al., "Antisense Drug Technology" Second Edition, CRC Press (2008) Chapters 1-28.

Daher et al., "Abrogation of α-synuclein-mediated dopaminergic neurodegeneration in LRRK2-deficient rats" PNAS (2014) 111: 9289-9294.

Daher et al., "Leucine-rich Repeat Kinase 2 (LRRK2) Pharmacological Inhibition Abates α-synuclein Gene-induced Neurodegeneration" J Biol Chem (2015) 290: 19433-19444.

Daher et al., "Neurodegenerative phenotypes in an A53T α-synuclein transgenic mouse model are independent of LRRK2" Hum Mol Genet (2012) 21: 2420-2431.

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

Genbank Acc. No. NM_198578.3.

Genbank Acc. No. NT_029419.11.

Gautschi et al., "Activity of a novel bcl-2/bcl-xLbispecific antisense oligonucleotide against tumors of diverse histologic origins" J. Natl. Cancer Inst. (2001) 93:463-471.

Guerreiro et al., "LRRK2 interactions with α-synuclein in Parkingson's disease brains and in cell models" J Mol Med (2013) 91: 513-522.

Henderson et al., "LRRK2 activity does not dramatically alter α-synuclein pathology in primary neurons" Acta Neuropathologica Comm (2018) 6: 1-11.

Herzig et al., "LRRK2 protein levels are determined by kinase function and are crucial for kidney and lung homeostasis in mice" Human Mol Gen (2011) 20(21): 4209-4223.

Herzig et al., "High LRRK2 Levels Fail to Induce or Exacerbate Neuronal Alpha-Synucleinopathy in Mouse Brain" PLoS One (2012) 7(5): 1-14.

Hinkle et al., "LRRK2 knockout mice have an intact dopaminergic system but display alterations in exploratory and motor co-ordination behaviors" Mol Neurodegener (2012) 7: 1-17.

International Search Report for PCT/US17/12374 dated Mar. 23, 2017.

International Search Report for PCT/US19/39558 dated Nov. 14, 2019.

Lin et al., "Leucine-rich repeat kinase 2 regulates the progression of neuropathology induced by Parkinson's-disease-related mutant alpha-synuclein" Neuron (2009) 64: 807-827.

Lloret et al., "Validation of LRRK2 as a Drug Target for Treatment of Parkinson's Disease Using Antisense Technology" Michael J. Fox Foundation Funded Grant Interim Progress Report, (2009) retreived from the internet on Sep. 11, 2018 (https://www.michaeljfox.org/foundation/grant-detail.php?grant_id=542).

Luk et al., "Pathological α-synuclein transmission initiates Parkinson-like neurodegeneration in nontransgenic mice" Science (2012) 338(6109): 949-953.

Maher et al., "Comparative hybrid arrest by tandem antisense oligodeoxy ribonucleotides or oligodeoxyribonucleoside methylpbosphonates in a cell-free system" Nucl. Acid. Res. (1998) 16(8):3341-3358.

New England Biolabs 1998/99 Catalog (cover page and pp. 121 and 284).

Nichols et al., "Substtate specificity and inhibitors of LRRK2, a protein kinase mutated in Parkinson's disease." Biochem J. (2009) 424(1):47-60.

O'Hara et al., "LRRK2 and α-Synuclein: Distinct or Synergistic Players in Parkinson's Disease?" Frontiers in Neuroscience (2020) 14: 1-18.

Reynolds et al., "Rational siRNA design for RNA interference" Nature Biotechnology (2004) 22(3):326-330.

Sanghvi et al., "Heterocyclic Base Modifications in Nucleic Acids and Their Applications in Antisense Oligonucleotides" Antisense Research and Applications (1993) pp. 273-288.

Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.

Sheng et al., "Deletion of the WD40 Domain of LRRK2 in Zebrafish Causes Parkinsonism-Like Loss of Neurons and Locomotive Defect" PloS Genetics (2010) 6(4):e1000914.

Sibley et al., "Identification of allele-specific RNAi effectors targeting genetic forms of Parkinson's disease" PLoS One (2011) 6(10): e26194.

Sibley et al., "Silencing of Parkinson's disease-associated genes with artificial mirtron mimics of miR-1224" Nucleic Acids Res. (2012) 40(19): 9863-9875.

Tong et al., "Loss of leucine-rich repeat kinase 2 causes age-dependent bi-phasic alterations of the autophagy pathway" Mol Neurodegener (2012) 7: 1-16.

Tran et al., "Antisense oligonucleotides to LRRK2 ameliorate alpha-synuclein pathology and behavioral deficit induced by preformed alpha-synuclein fibrils." Abstract from Society for Neuroscience meeting Nov. 15, 2016, retreived from the internet Aug. 15, 2018 http://www.abstractsonline.com/pp8/index.html#!/4071/presentation/14652/.

Volpicelli-Daley et al., "LRRK2 Expression Augments α-Synuclein Sequestration into Inclusions in Neurons" J Neuroscience (2016) 36(28):7415-7427.

Volpicelli-Daley et al., "LRRK2 facilitates formation of alph-synuclein inclusions." abstract from Society for Neuroscience meeting, Nov. 15, 2016, retreived online Aug. 21, 2018 http://www.abstractsonline.com/pp8/index.html#!/4071/presentation/14651.

Volta et al., "Chronic and acute LRRK2 silencing has no long-term behavioral effects, whereas wild-type and mutant LRRK2 overexpression induce motor and cognitive deficits and altered regulation of dopamine release." Parkinsonism anRelat Disord (2015) 21(10):1156-63.

Woolf et al., "Specificity of antisense oligonucleotides in vivo" PNAS (1992) 89: 7305-7309.

Ynigo-Mojado et al., "Efficient allele-specific targeting of LRRK2 R1441 mutations mediated by RNAi" PLoS One (2011) 6: e21352.

(56) References Cited

OTHER PUBLICATIONS

Zhao et al., "Antisense oligonucleotides to LRRK2 ameliorate alpha-synuclein pathology and behavioral deficit induced by pre-formed alpha-sunuclein fibrils" Abstract from American Acadamy of Neurology meeting, Oct. 16, 2012, retreived from the internet Aug. 15, 2018: http://www.abstractsonline.com/pp8/#!/4046/presentation/8588.

Zhao et al., "Antisense Oligonucleotides to LRRK2 Ameliorate alpha-Synuclein Pathology and Behavioral Deficit Induced by Pre-Formed alpha-Synuclein Fibrils." Annals of Neurology (2017) 82(21):S56-S57.

Zhao et al., "Antisense Oligonucleotides to LRRK2 Ameliorate alpha-Synuclein Pathology and Behavioral Deficit Induced by Pre-Formed alpha-Synuclein Fibrils." 13th International Conference on Alzheimer's and Parkinson's diseases, abstract presented Apr. 1, 2017.

Zhao et al., "LRRK2 Antisense Oligonucleotides Ameliorate α-Synuclein Inclusion Formation in a Parkinson's Disease Mouse Model" Mol Ther Nucleic Acids (2017) 8:508-519.

Cole et al., "Antisense Oligonucleotide Therapeutics for the Treatment of Neurodegenerative Diseases" Presentation for Genetic Epidemiology of Parkinson's Disease (GEO-PD) (Sep. 12, 2014).

Hirst "LRRK2 ASO: Path to the Clinic" Abstract for Michael J Fox LRRK2 Summit (Mar. 25-26, 2019).

Swayze "This Is Your Brain on Antisense Oligonucleotides: Distribution, Activity and Application to the Treatment of Severe Neurodegenerative Disease" Abstract for 253rd Meeting of the American Chemical Society (Apr. 2-6, 2017).

Swayze "This Is Your Brain on Antisense Oligonucleotides: Distribution, Activity and Application to the Treatment of Severe Neurodegenerative Disease" Presentation for 253rd Meeting of the American Chemical Society (Apr. 2, 2017).

Tatarnikov et al., "Neurotransmission in LRRK2 and VPS35 mutant mice—rescued by acute LRRK2 knock-down" Presentation for Society for Neuroscience Annual Meeting (Sep. 15, 2016).

Zhao et al., "Antisense oligonucleotides to LRRK2 ameliorate alpha-synuclein pathology and behavioral deficit induced by pre-formed alpha-synuclein fibrils" Presentation for Society for Neuroscience Annual Meeting (Sep. 15, 2016).

Zhao "Inhibitors of Leucine-rich Repeat Kinase 2 (LRRK2): Progress & Promise for the Treatment of Parkinson's Disease" Presentation for World CNS Summit (Feb. 20, 2017).

Zhao et al., "LRRK2 Antisense Oligonucleotides Ameliorate α-Synuclein Inclusion Formation in a Parkinson's Disease Mouse Model" Abstract for 142nd Annual Meeting of the American Neurological Association (Oct. 15-17, 2017).

Zhao et al., "LRRK2 Antisense Oligonucleotides Ameliorate α-Synuclein Inclusion Formation in a Parkinson's Disease Mouse Model" Poster for 142nd Annual Meeting of the American Neurological Association (Oct. 15-17, 2017).

COMPOUNDS AND METHODS FOR REDUCING LRRK2 EXPRESSION

SEQUENCE LISTING

The present application is being filed along with a Sequence Listing in electronic format. The Sequence Listing is provided as a file entitled BIOL0324USASEQ_ST25.txt, created on Dec. 2, 2020, which is 1.12 MB in size. The information in the electronic format of the sequence listing is incorporated herein by reference in its entirety.

FIELD

Provided are compounds, methods, and pharmaceutical compositions for reducing the amount or activity of leucine-rich repeat kinase 2 (LRRK2) RNA in a cell or animal, and in certain instances reducing the amount of LRRK2 protein in a cell or animal Such compounds, methods, and pharmaceutical compositions are useful to ameliorate at least one symptom or hallmark of a neurodegenerative disease. Such symptoms and hallmarks include ataxia, neuropathy, and aggregate formation. Such neurodegenerative diseases include Parkinson's disease.

BACKGROUND

The LRRK2 gene encodes a protein with an armadillo repeat (ARM) region, an ankyrin repeat (ANK) region, a leucine-rich repeat (LRR) domain, a kinase domain, a RAS domain, a GTPase domain, and a WD40 domain. The protein is present largely in the cytoplasm but also associates with the mitochondrial outer membrane. One segment of the LRRK2 protein is enriched with leucine and may be involved in signal transduction and cytoskeleton assembly. Other parts of the LRRK2 protein are also thought to be involved in protein-protein interactions. Additional studies indicate that LRRK2 protein has an enzyme function known as kinase activity, including phosphorylation and GTPase activity. LRRK2 is active in the brain and other tissues throughout the body.

Genomewide association studies have found an association between LRRK2 and Parkinson's disease. Indeed, LRRK2 is the greatest known genetic contributor to Parkinson's disease. Nonetheless, Parkinson's disease has not been considered to be a genetic disease. The majority of Parkinson's disease cases are idiopathic. Approximately 10 percent of Parkinson's disease cases have been linked to a genetic cause. Mutations in the LRRK2 gene are the most common cause of Parkinson's disease in this relatively small group, representing one to two percent of total Parkinson's disease cases.

Currently there is a lack of acceptable options for treating neurodegenerative diseases such as Parkinson's disease, including non-LRRK2 mediated Parkinson's disease. It is therefore an object herein to provide compounds, methods, and pharmaceutical compositions for the treatment of such diseases.

SUMMARY OF THE INVENTION

Provided herein are compounds, methods and pharmaceutical compositions for reducing the amount or activity of LRRK2 RNA, and in certain embodiments reducing the amount of LRRK2 protein in a cell or animal. In certain embodiments, the animal has a neurodegenerative disease. In certain embodiments, the animal has Parkinson's disease. In certain embodiments, compounds useful for reducing expression of LRRK2 RNA are oligomeric compounds. In certain embodiments, compounds useful for reducing expression of LRRK2 RNA are modified oligonucleotides.

Also provided are methods useful for ameliorating at least one symptom or hallmark of a neurodegenerative disease. In certain embodiments, the neurodegenerative disease is Parkinson's disease. In certain embodiments, the Parkinson's disease is either LRRK2 mediated Parkinson's disease or non-LRRK2 mediated Parkinson's disease. In certain embodiments, the symptom or hallmark includes ataxia, neuropathy, and aggregate formation. In certain embodiments, amelioration of these symptoms results in improved motor function, reduced neuropathy, and reduction in number of aggregates.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyribosyl sugar moiety, as found in naturally occurring deoxyribonucleic acids (DNA). In certain embodiments, a 2'-deoxynucleoside may comprise a modified nucleobase or may comprise an RNA nucleobase (uracil).

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "5-methyl cytosine" means a cytosine modified with a methyl group attached to the 5 position. A 5-methyl cytosine is a modified nucleobase.

As used herein, "administering" means providing a pharmaceutical agent to an animal.

As used herein, "animal" means a human or non-human animal.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is ataxia, neuropathy, and aggregate formation. In certain embodiments, amelioration of these symptoms results in improved motor function, reduced neuropathy, and reduction in number of aggregates.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more regions thereof and the nucleobases of another nucleic acid or one or more regions thereof are capable of hydrogen bonding with one another when the nucleobase sequence of the oligonucleotide and the other nucleic acid are aligned in opposing directions. Complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or nucleic acids need not have nucleobase complementarity at each nucleoside. Rather, some mismatches are tolerated. As used herein, "fully complementary" or "100% complementary" in reference to oligonucleotides means that oligonucleotides are complementary to another oligonucleotide or nucleic acid at each nucleoside of the oligonucleotide.

As used herein, "conjugate group" means a group of atoms that is directly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "constrained ethyl" or "cEt" or "cEt modified sugar" means a β-D ribosyl bicyclic sugar moiety wherein the second ring of the bicyclic sugar is formed via a bridge connecting the 4'-carbon and the 2'-carbon of the β-D ribosyl sugar moiety, wherein the bridge has the formula 4'-CH(CH$_3$)—O-2', and wherein the methyl group of the bridge is in the S configuration.

As used herein, "cEt nucleoside" means a nucleoside comprising cEt modified sugar.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." Unless otherwise indicated, "gapmer" refers to a sugar motif. Unless otherwise indicated, the sugar moieties of the nucleosides of the gap of a gapmer are unmodified 2'-deoxyribosyl. Thus, the term "MOE gapmer" indicates a gapmer having a sugar motif of 2'-MOE nucleosides in both wings and a gap of 2'-deoxynucleosides. Unless otherwise indicated, a MOE gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, the term "internucleoside linkage" is the covalent linkage between adjacent nucleosides in an oligonucleotide. As used herein "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "MOE" means methoxyethyl. "2'-MOE" or "2'-MOE modified sugar" means a 2'-OCH$_2$CH$_2$OCH$_3$ group in place of the 2'-OH group of a ribosyl sugar moiety. As used herein, "2'-MOE nucleoside" means a nucleoside comprising a 2'-MOE modified sugar.

As used herein, "motif" means the pattern of unmodified and/or modified sugar moieties, nucleobases, and/or internucleoside linkages, in an oligonucleotide.

As used herein, "RNA" means an RNA transcript that encodes a protein and includes pre-mRNA and mature mRNA unless otherwise specified.

As used herein, "neurodegenerative disease" means a condition marked by progressive loss of function or structure, including loss of motor function and death of neurons. In certain embodiments, the neurodegenerative disease is Parkinson's disease. In certain embodiments, the Parkinson's disease may be LRRK2 mediated Parkinson's disease or non-LRRK2 mediated Parkinson's disease.

"Non-LRRK2 mediated Parkinson's Disease" is a diagnosis of Parkinson's disease not associated with a causative LRRK2 genetic mutation. Causative LRRK2 genetic mutations include G2019S, R1441C, R1441G, I2020T, and Y1699C. Diagnosis of Parkinson's disease may be accomplished by any method including evaluating an individual's medical history, observation of signs and symptoms, and standard clinical tests or assessments. Genetic testing for a mutation associated with LRRK2, such as G2019S, R1441C, R1441G, I2020T, and Y1699C, may reveal whether an individual has non-LRRK2 mediated Parkinson's disease. An individual having a diagnosis of Parkinson's disease, but without a causative LRRK2 mutation, has non-LRRK2 mediated Parkinson's disease. "Identifying an animal having non-LRRK2 mediated Parkinson's Disease" means identifying an animal having been diagnosed with Parkinson's Disease or predisposed to develop Parkinson's Disease without a causative LRRK2 mutation.

As used herein, "nucleobase" means an unmodified nucleobase or a modified nucleobase. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a nucleic acid or oligonucleotide independent of any sugar or internucleoside linkage modification.

As used herein, "nucleoside" means a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to an animal Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution or sterile artificial cerebrospinal fluid.

As used herein "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein "prodrug" means a therapeutic agent in a form outside the body that is converted to a different form within an animal or cells thereof. Typically conversion of a prodrug within the animal is facilitated by the action of an enzymes (e.g., endogenous or viral enzyme) or chemicals present in cells or tissues and/or by physiologic conditions.

As used herein, "reducing or inhibiting the amount or activity" refers to a reduction or blockade of the transcriptional expression or activity relative to the transcripexpression or activity in an untreated or control sample and does not necessarily indicate a total elimination of transcriptional expression or activity.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "siRNA" refers to a ribonucleic acid molecule having a duplex structure including two antiparallel and substantially complementary nucleic acid strands. The two strands forming the duplex structure may be different portions of one larger RNA molecule, or they may be separate RNA molecules. Where the two strands are part of one larger molecule, and therefore are connected by consecutive nucleobases between the 3'-end of one strand and the 5' end of the respective other strand forming the duplex structure, the connecting RNA chain is referred to as a "hairpin loop". The RNA strands may have the same or a different number of nucleotides.

As used herein, "standard cell assay" means the assay described in Example 4 and reasonable variations thereof.

As used herein, "standard in vivo assay" means the experiment described in Example 14 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the results of a synthetic method that is not designed to control the stereochemical configuration. In certain embodiments, a stereorandom chiral center is a stereorandom phosphorothioate internucleoside linkage.

As used herein, "sugar moiety" means an unmodified sugar moiety or a modified sugar moiety. As used herein, "unmodified sugar moiety" means a 2'-OH(H) ribosyl moiety, as found in RNA (an "unmodified RNA sugar moiety"), or a 2'-H(H) deoxyribosyl moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to an animal. For example, a therapeutically effective amount improves a symptom of a disease.

Certain Embodiments

The present disclosure provides the following non-limiting numbered embodiments:

Embodiment 1. An oligomeric compound comprising a modified oligonucleotide consisting of 12 to 50 linked nucleosides wherein the nucleobase sequence of the modified oligonucleotide is at least 90% complementary to an equal length portion of a LRRK2 nucleic acid, and wherein the modified oligonucleotide comprises at least one modification selected from a modified sugar, a sugar surrogate, and a modified internucleoside linkage.

Embodiment 2: An oligomeric compound comprising a modified oligonucleotide consisting of 12 to 50 linked nucleosides and having a nucleobase sequence comprising at least 12, at least 13, at least 14, at least 15, at least 16, at least 17, at least 18, at least 19, or at least 20 contiguous nucleobases of any of the nucleobase sequences of SEQ ID NOS: 30-3847.

Embodiment 3: An oligomeric compound comprising a modified oligonucleotide consisting of 12 to 50 linked nucleosides and having a nucleobase sequence comprising a portion of at least 8, at least 9, at least 10, at least 11, at least 12, at least 13, at least 14, at least 15, at least 16, at least 17, at least 18, at least 19, or at least 20 contiguous nucleobases, wherein the portion is complementary to:

an equal length portion of nucleobases 18,633-18,658 of SEQ ID NO: 2;

an equal length portion of nucleobases 21,721-21,755 of SEQ ID NO: 2;

an equal length portion of nucleobases 27,963-28,016 of SEQ ID NO: 2;

an equal length portion of nucleobases 35,415-35,446 of SEQ ID NO: 2;

an equal length portion of nucleobases 77,221-77,264 of SEQ ID NO: 2;

an equal length portion of nucleobases 81,581-81,612 and/or 87,838-87,869 of SEQ ID NO: 2;

an equal length portion of nucleobases 81,627-81,651 of SEQ ID NO: 2;

an equal length portion of nucleobases 82,058-82,081 of SEQ ID NO: 2;

an equal length portion of nucleobases 82,180-82,220 of SEQ ID NO: 2;

an equal length portion of nucleobases 82,500-82,525 of SEQ ID NO: 2;

an equal length portion of nucleobases 91,038-91,067 of SEQ ID NO: 2;

an equal length portion of nucleobases 92,148-92,173 of SEQ ID NO: 2;

am equal length portion of nucleobases 98,186-98,220 of SEQ ID NO: 2;

an equal length portion of nucleobases 98,218-98,242 of SEQ ID NO: 2;

an equal length portion of nucleobases 99,199-99,223 of SEQ ID NO: 2;

an equal length portion of nucleobases 119,903-119,936 of SEQ ID NO: 2; or an equal length portion of nucleobases 4,062-4,086 of SEQ ID NO: 1.

Embodiment 4. The oligomeric compound of any of embodiments 1-3, wherein the modified oligonucleotide has a nucleobase sequence that is at least 80%, 85%, 90%, 95%, or 100% complementary to the nucleobase sequence of SEQ ID NO: 1 or SEQ ID NO: 2, when measured across the entire nucleobase sequence of the modified oligonucleotide.

Embodiment 5. The oligomeric compound of any of embodiments 1-4, wherein the modified oligonucleotide comprises at least one modified nucleoside.

Embodiment 6. The oligomeric compound of embodiment 5, wherein the modified oligonucleotide comprises at least one modified nucleoside comprising a modified sugar moiety.

Embodiment 7. The oligomeric compound of embodiment 6, wherein the modified oligonucleotide comprises at least one modified nucleoside comprising a bicyclic sugar moiety.

Embodiment 8. The oligomeric compound of embodiment 7, wherein the modified oligonucleotide comprises at least one modified nucleoside comprising a bicyclic sugar moiety having a 2'-4' bridge, wherein the 2'-4' bridge is selected from —O—CH$_2$—; and —O—CH(CH$_3$)—.

Embodiment 9. The oligomeric compound of any of embodiments 5-8, wherein the modified oligonucleotide comprises at least one modified nucleoside comprising a non-bicyclic modified sugar moiety.

Embodiment 10. The oligomeric compound of embodiment 9, wherein the modified oligonucleotide comprises at least one modified nucleoside comprising a non-bicyclic modified sugar moiety comprising a 2'-MOE modified sugar or 2'-OMe modified sugar.

Embodiment 11. The oligomeric compound of any of embodiments 5-10, wherein the modified oligonucleotide comprises at least one modified nucleoside comprising a sugar surrogate.

Embodiment 12. The oligomeric compound of embodiment 11, wherein the modified oligonucleotide comprises at least one modified nucleoside comprising a sugar surrogate selected from morpholino and PNA.

Embodiment 13. The oligomeric compound of any of embodiments 1-12, wherein the modified oligonucleotide has a sugar motif comprising:

a 5'-region consisting of 1-5 linked 5'-region nucleosides;

a central region consisting of 6-10 linked central region nucleosides; and a 3'-region consisting of 1-5 linked 3'-region nucleosides; wherein each of the 5'-region nucleosides and each of the 3'-region nucleosides comprises a modified sugar moiety and each of the central region nucleosides comprises an unmodified 2'-deoxyribosyl sugar moiety.

Embodiment 14. The oligomeric compound of any of embodiments 1-13, wherein the modified oligonucleotide comprises at least one modified internucleoside linkage.

Embodiment 15. The oligomeric compound of embodiment 14, wherein each internucleoside linkage of the modified oligonucleotide is a modified internucleoside linkage.

Embodiment 16. The oligomeric compound of embodiment 14 or 15 wherein at least one internucleoside linkage is a phosphorothioate internucleoside linkage.

Embodiment 17. The oligomeric compound of embodiment 14 or 16 wherein the modified oligonucleotide comprises at least one phosphodiester internucleoside linkage.

Embodiment 18. The oligomeric compound of any of embodiments 14, 16, or 17, wherein each internucleoside linkage is either a phosphodiester internucleoside linkage or a phosphorothioate internucleoside linkage.

Embodiment 19. The oligomeric compound of any of embodiments 1-18, wherein the modified oligonucleotide comprises at least one modified nucleobase.

Embodiment 20. The oligomeric compound of embodiment 19, wherein the modified nucleobase is a 5-methyl cytosine.

Embodiment 21. The oligomeric compound of any of embodiments 1-20, wherein the modified oligonucleotide consists of 12-30, 12-22, 12-20, 14-20, 15-25, 16-20, 18-22 or 18-20 linked nucleosides.

Embodiment 22. The oligomeric compound of any of embodiments 1-21, wherein the modified oligonucleotide consists of 17 or 20 linked nucleosides.

Embodiment 23. The oligomeric compound of any of embodiments 1-22 consisting of the modified oligonucleotide.

Embodiment 24. The oligomeric compound of any of embodiments 1-22 comprising a conjugate group comprising a conjugate moiety and a conjugate linker.

Embodiment 25. The oligomeric compound of embodiment 24, wherein the conjugate group comprises a GalNAc cluster comprising 1-3 GalNAc ligands.

Embodiment 26. The oligomeric compound of embodiment 24 or 25, wherein the conjugate linker consists of a single bond.

Embodiment 27. The oligomeric compound of embodiment 25, wherein the conjugate linker is cleavable.

Embodiment 28. The oligomeric compound of embodiment 27, wherein the conjugate linker comprises 1-3 linker-nucleosides.

Embodiment 29. The oligomeric compound of any of embodiments 24-28, wherein the conjugate group is attached to the modified oligonucleotide at the 5'-end of the modified oligonucleotide.

Embodiment 30. The oligomeric compound of any of embodiments 24-28, wherein the conjugate group is attached to the modified oligonucleotide at the 3'-end of the modified oligonucleotide.

Embodiment 31. The oligomeric compound of any of embodiments 1-30 comprising a terminal group.

Embodiment 32. The oligomeric compound of any of embodiments 1-31 wherein the oligomeric compound is a singled-stranded oligomeric compound.

Embodiment 33. The oligomeric compound of any of embodiments 1-27 or 29-31, wherein the oligomeric compound does not comprise linker-nucleosides.

Embodiment 34. An oligomeric duplex comprising an oligomeric compound of any of embodiments 1-31 or 33.

Embodiment 35. An antisense compound comprising or consisting of an oligomeric compound of any of embodiments 1-33 or an oligomeric duplex of embodiment 34.

Embodiment 36. A pharmaceutical composition comprising an oligomeric compound of any of embodiments 1-33 or an oligomeric duplex of embodiment 34 and a pharmaceutically acceptable carrier or diluent.

Embodiment 37. A modified oligonucleotide according to the following formula:
(SEQ ID NO: 222)
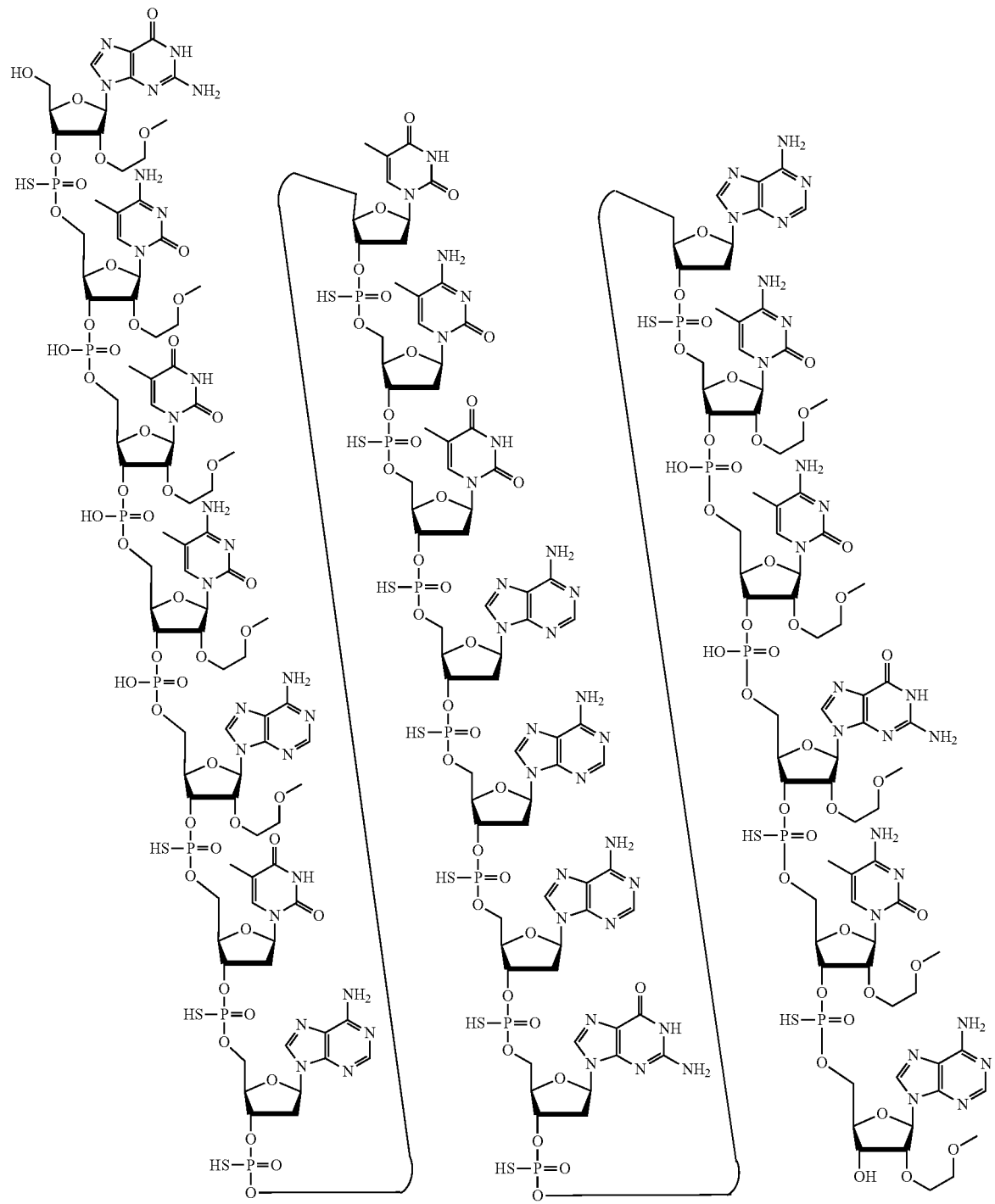
(SEQ ID NO: 222)
or a salt thereof.

Embodiment 38. A modified oligonucleotide according to the following formula:
(SEQ ID NO: 888)
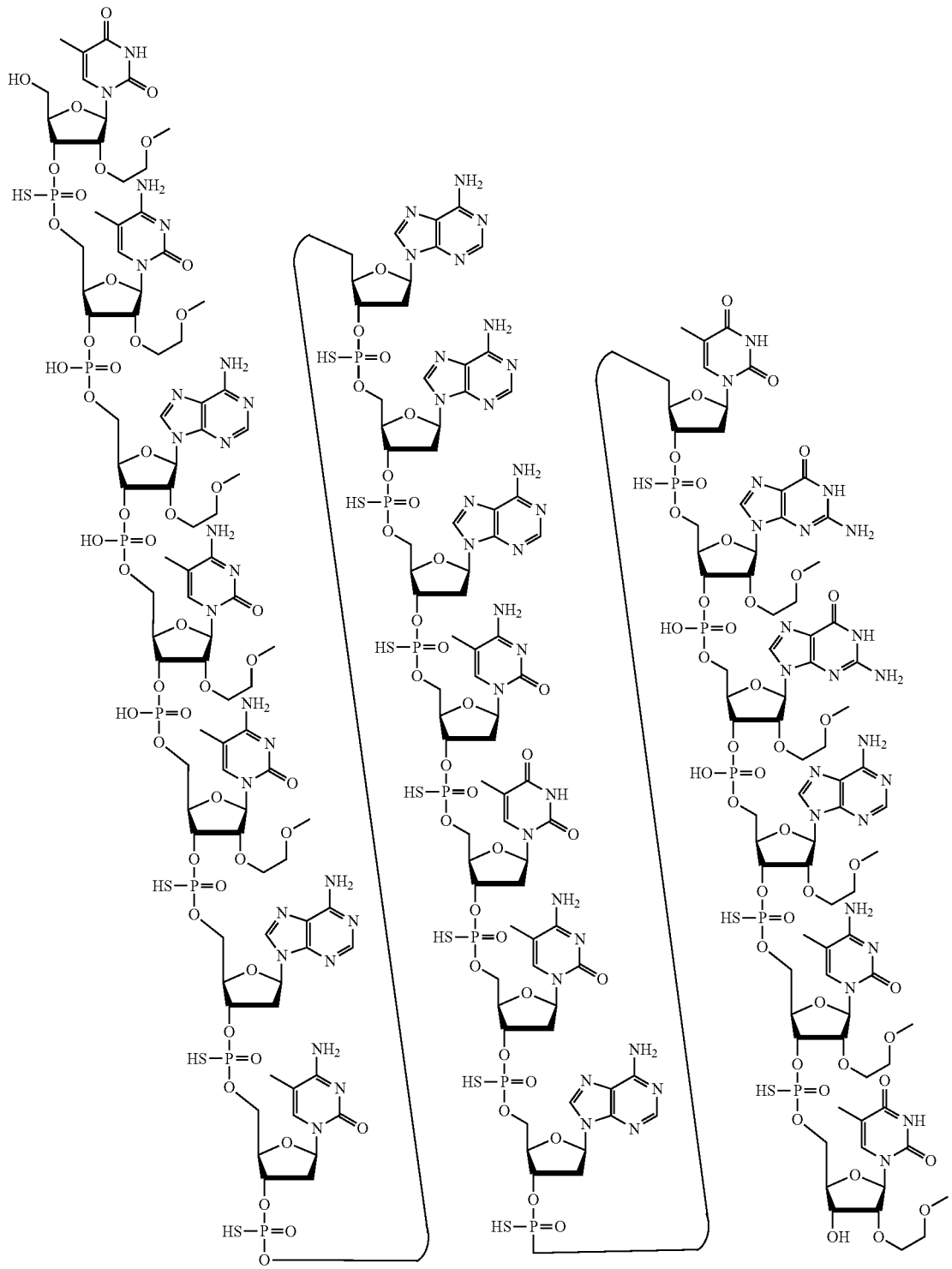
(SEQ ID NO: 888)
or a salt thereof.

Embodiment 39. A modified oligonucleotide according to the following formula:
(SEQ ID NO: 1431)
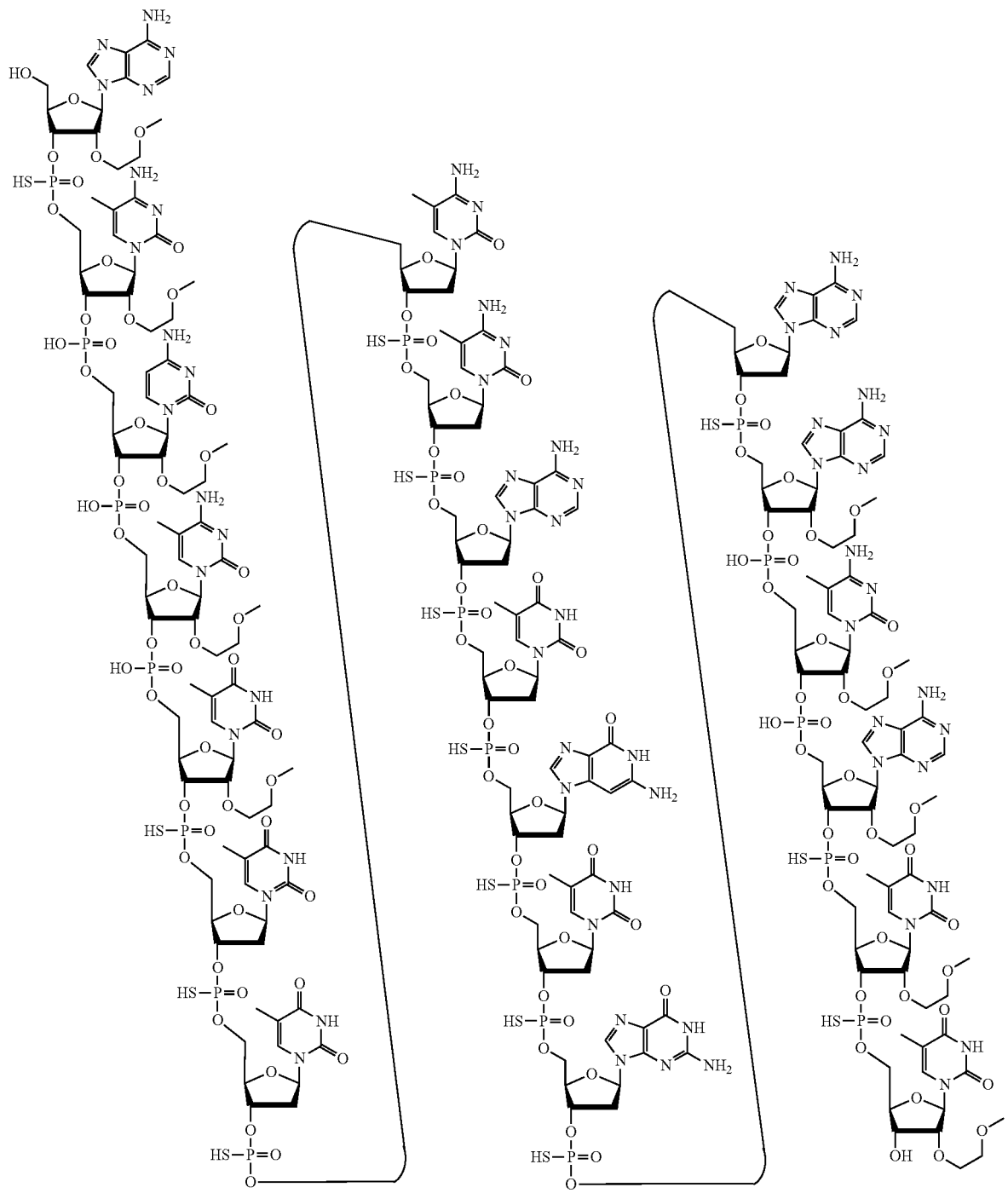
(SEQ ID NO: 1431)
or a salt thereof.

Embodiment 40. A modified oligonucleotide according to the following formula:
(SEQ ID NO: 3590)
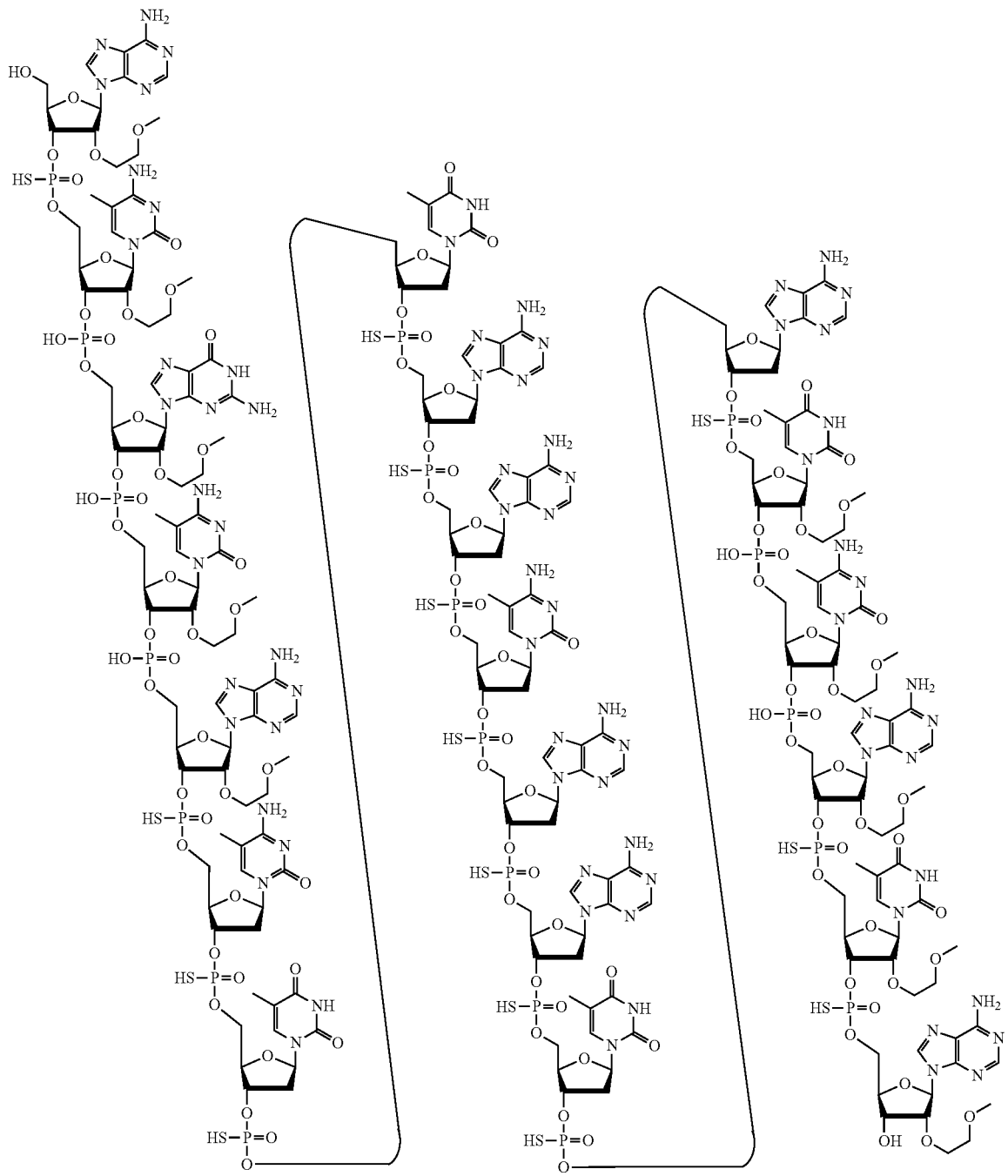
(SEQ ID NO: 3590)
or a salt thereof.

Embodiment 41. A modified oligonucleotide according to the following formula:
(SEQ ID NO: 3385)
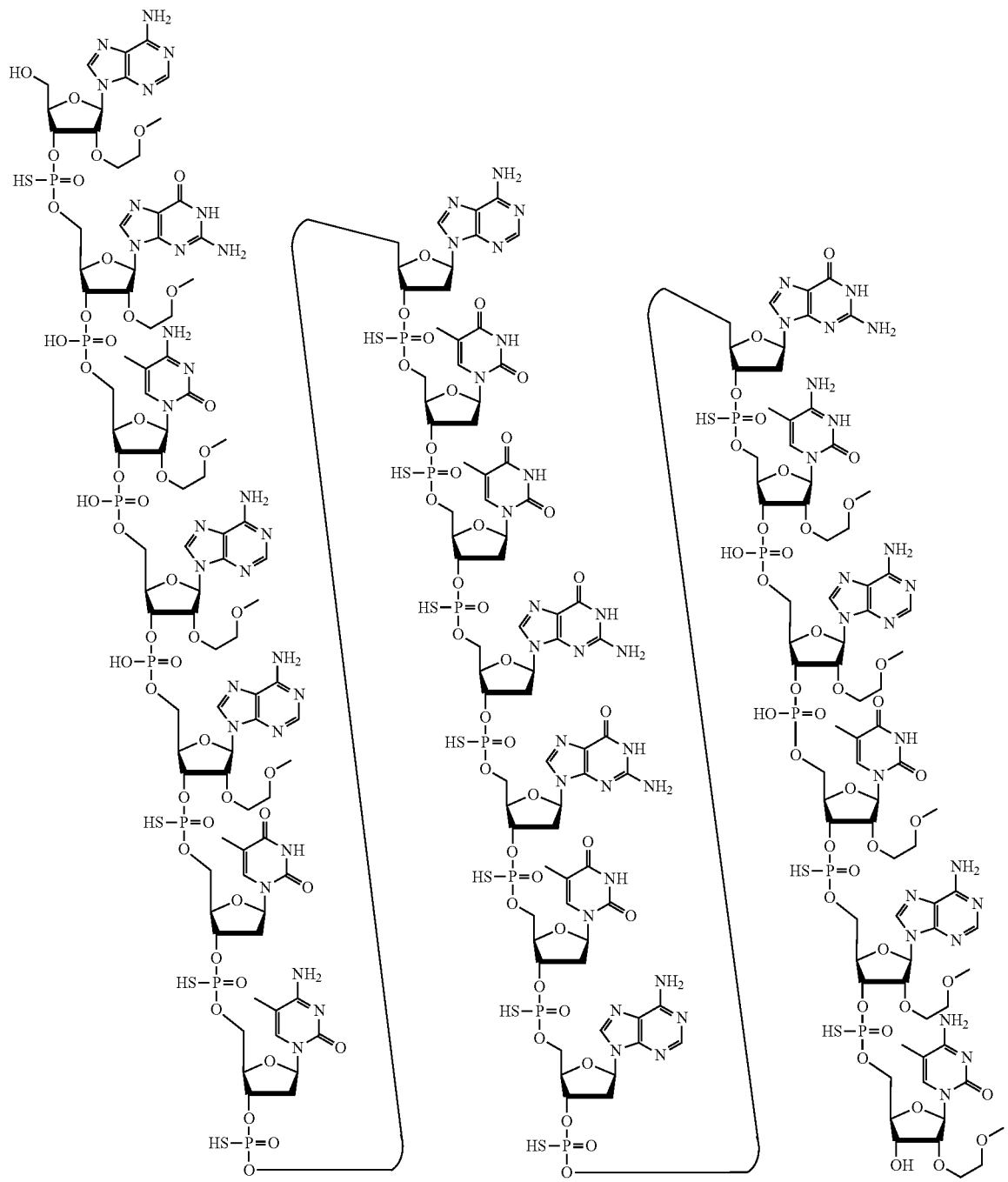
(SEQ ID NO: 3385)
or a salt thereof.

Embodiment 42. A modified oligonucleotide according to the following formula:
(SEQ ID NO: 852)
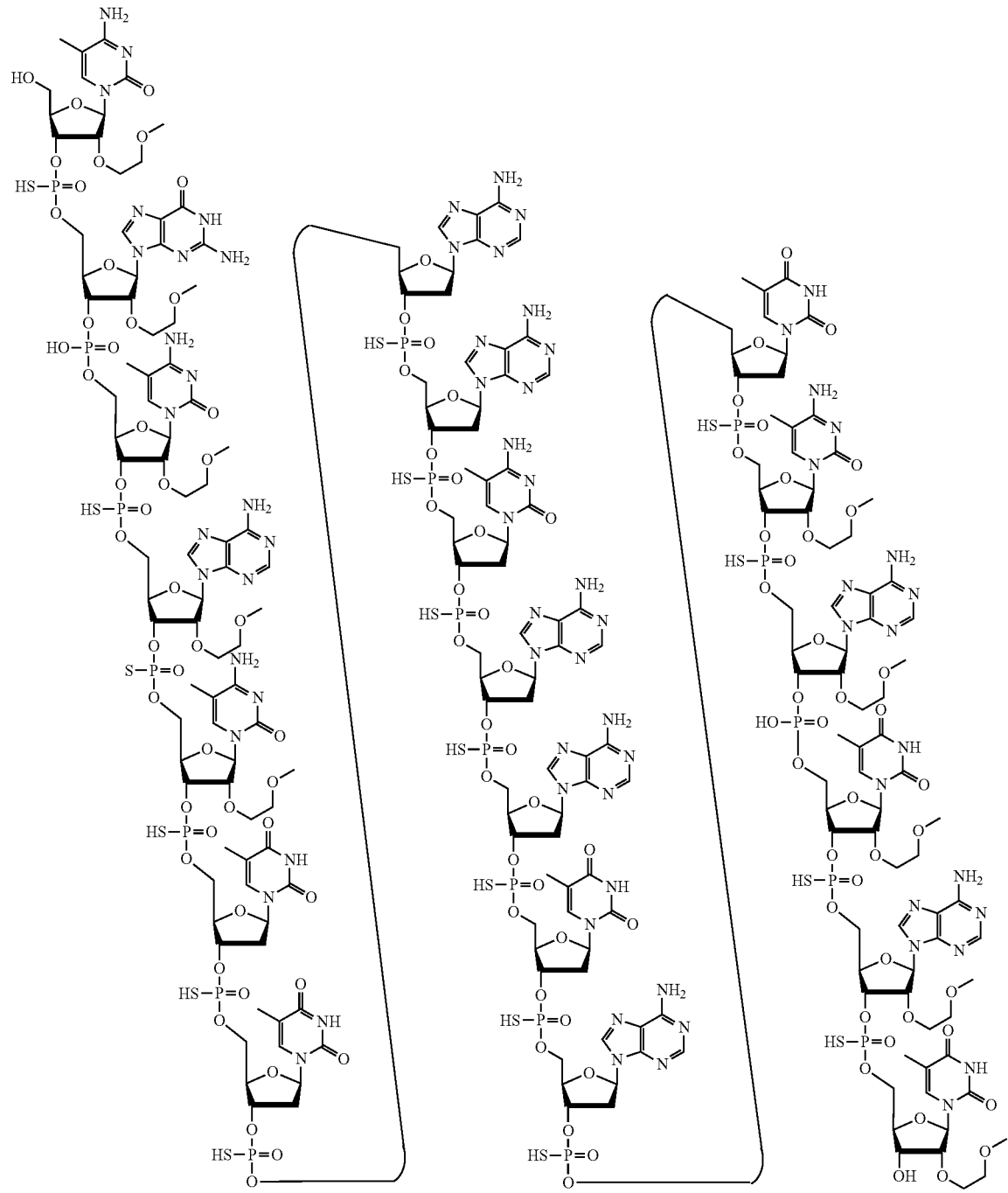
(SEQ ID NO: 852)
or a salt thereof.
Embodiment 43. The modified oligonucleotide of any of embodiments 37-42, which is a sodium salt of the formula.

Embodiment 44. A modified oligonucleotide according to the following formula:
(SEQ ID NO: 222)
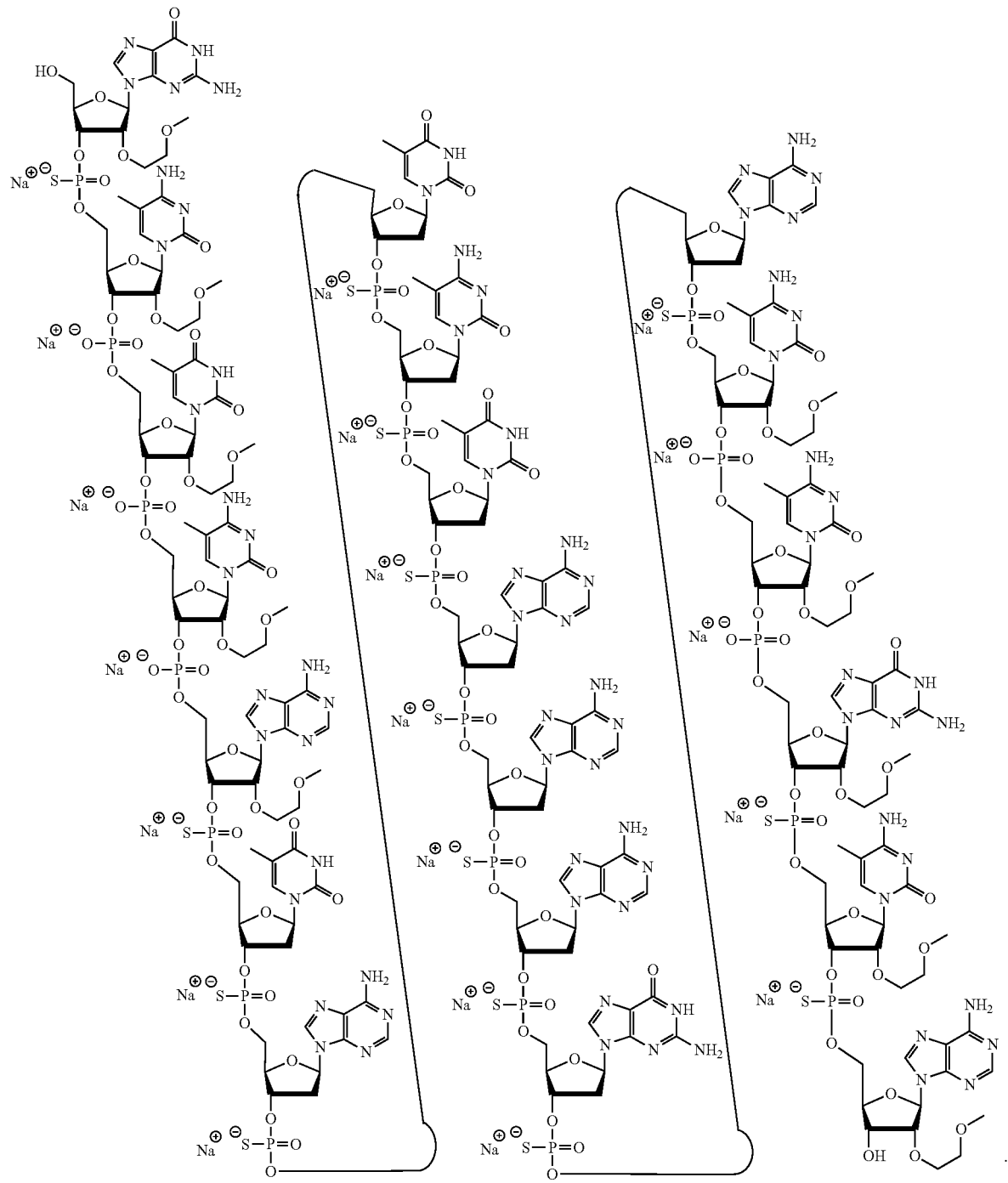
(SEQ ID NO: 222).

Embodiment 45. A modified oligonucleotide according to the following formula:
(SEQ ID NO: 888)
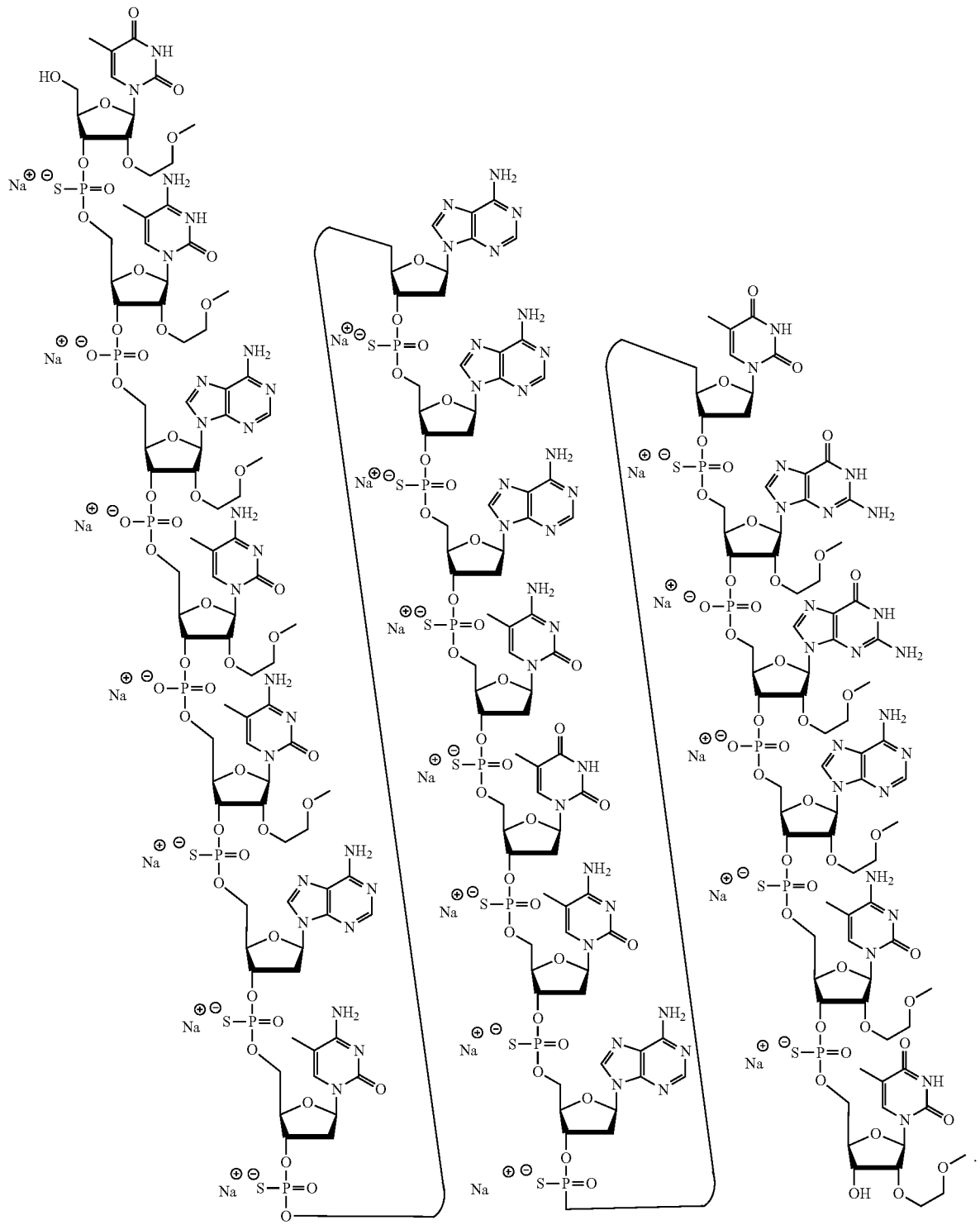
(SEQ ID NO: 888).

Embodiment 46. A modified oligonucleotide according to the following formula:
(SEQ ID NO: 1431)
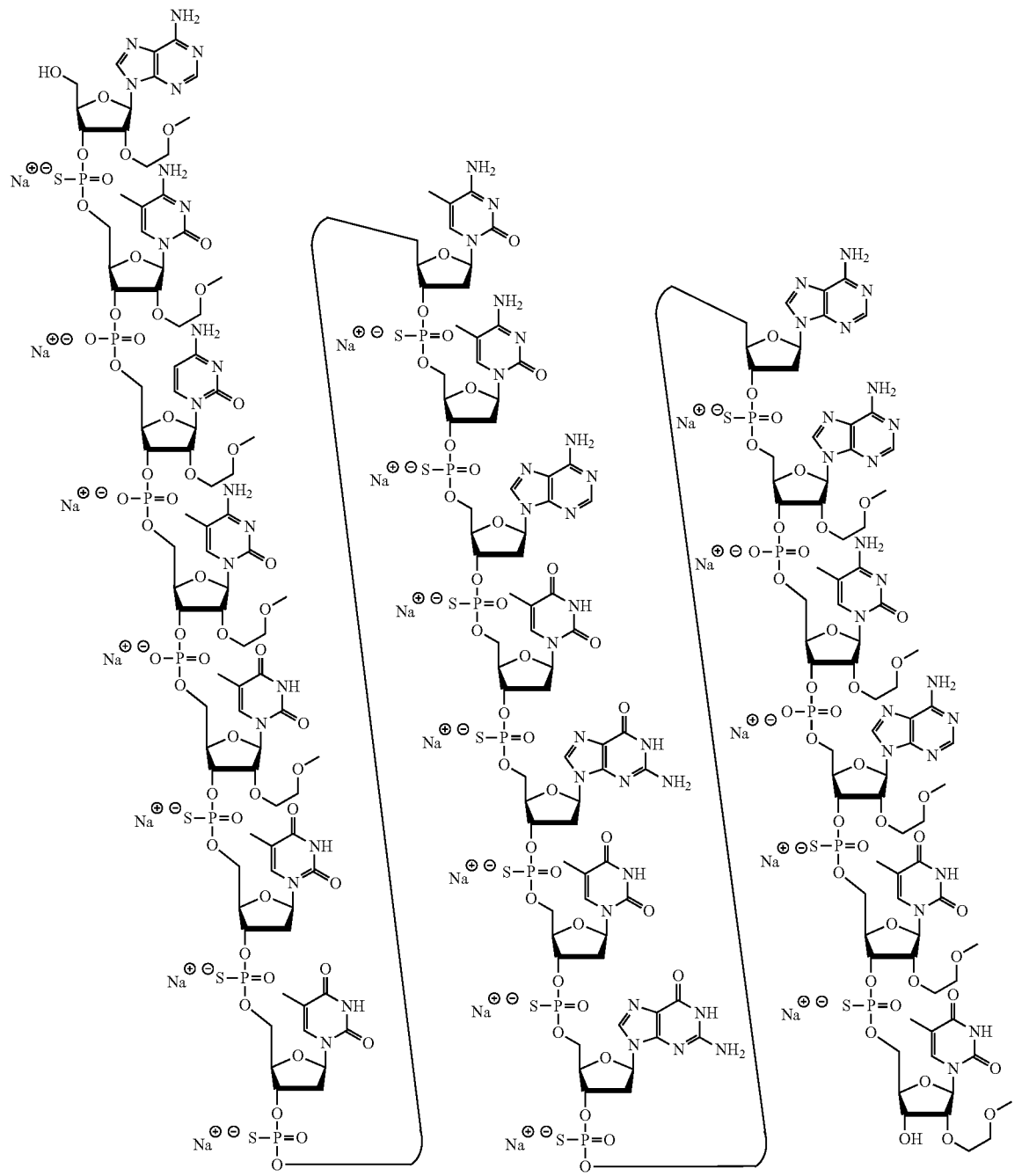
(SEQ ID NO: 1431).

Embodiment 47. A modified oligonucleotide according to the following formula:
(SEQ ID NO: 3590)
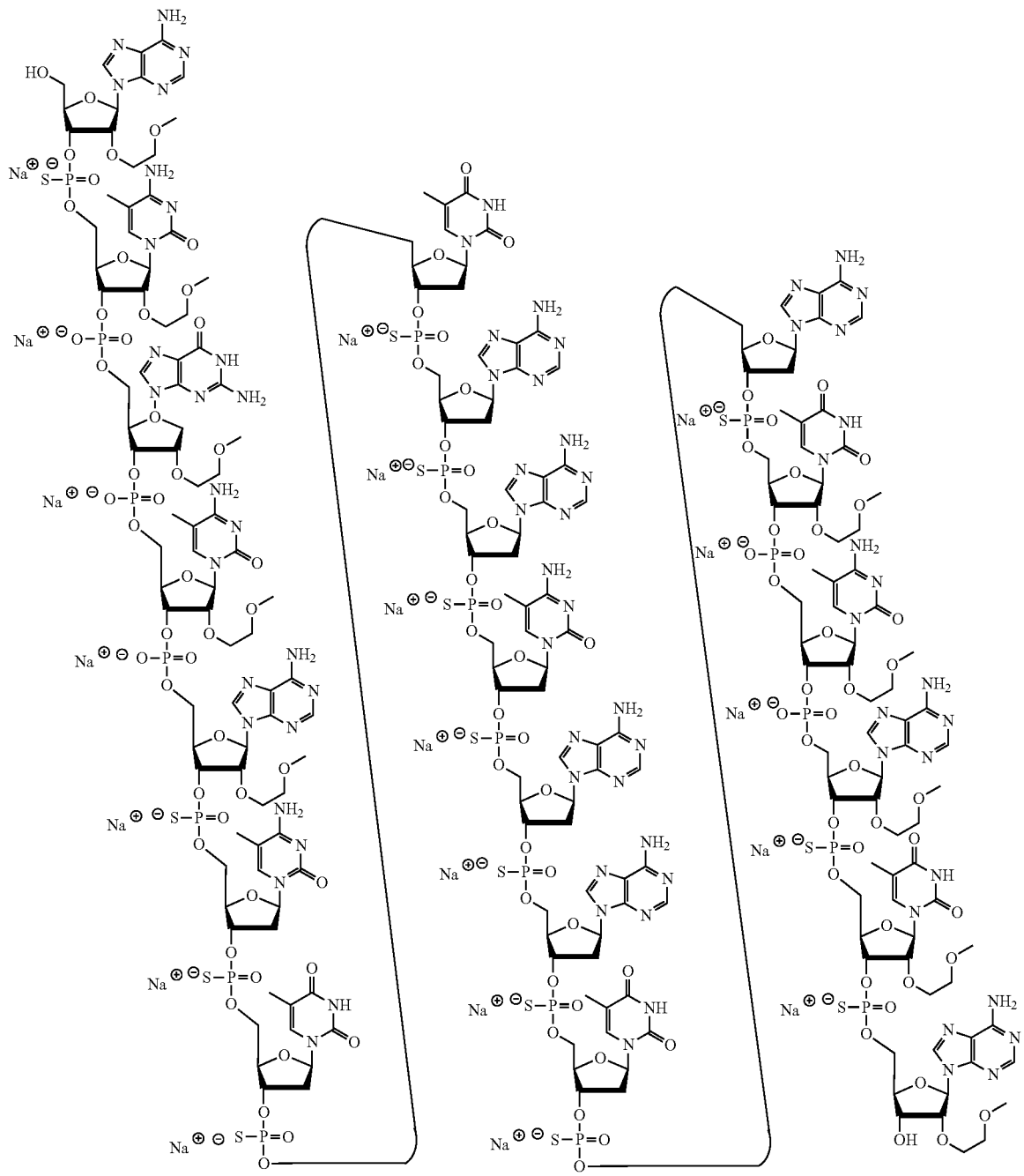
(SEQ ID NO: 3590).

Embodiment 48. A modified oligonucleotide according to the following formula:
(SEQ ID NO: 3385)
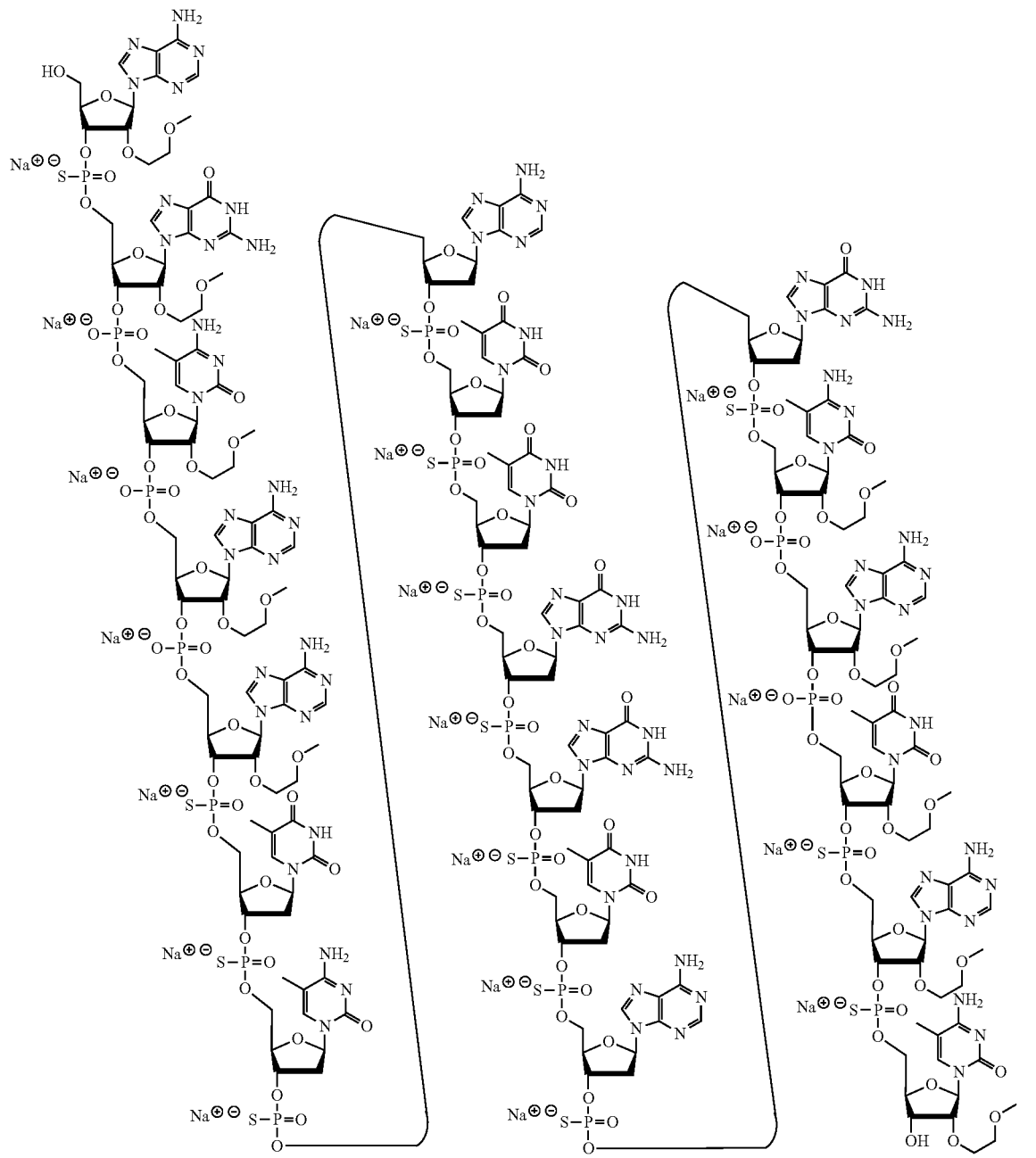
(SEQ ID NO: 3385).

Embodiment 49. A modified oligonucleotide according to the following formula:

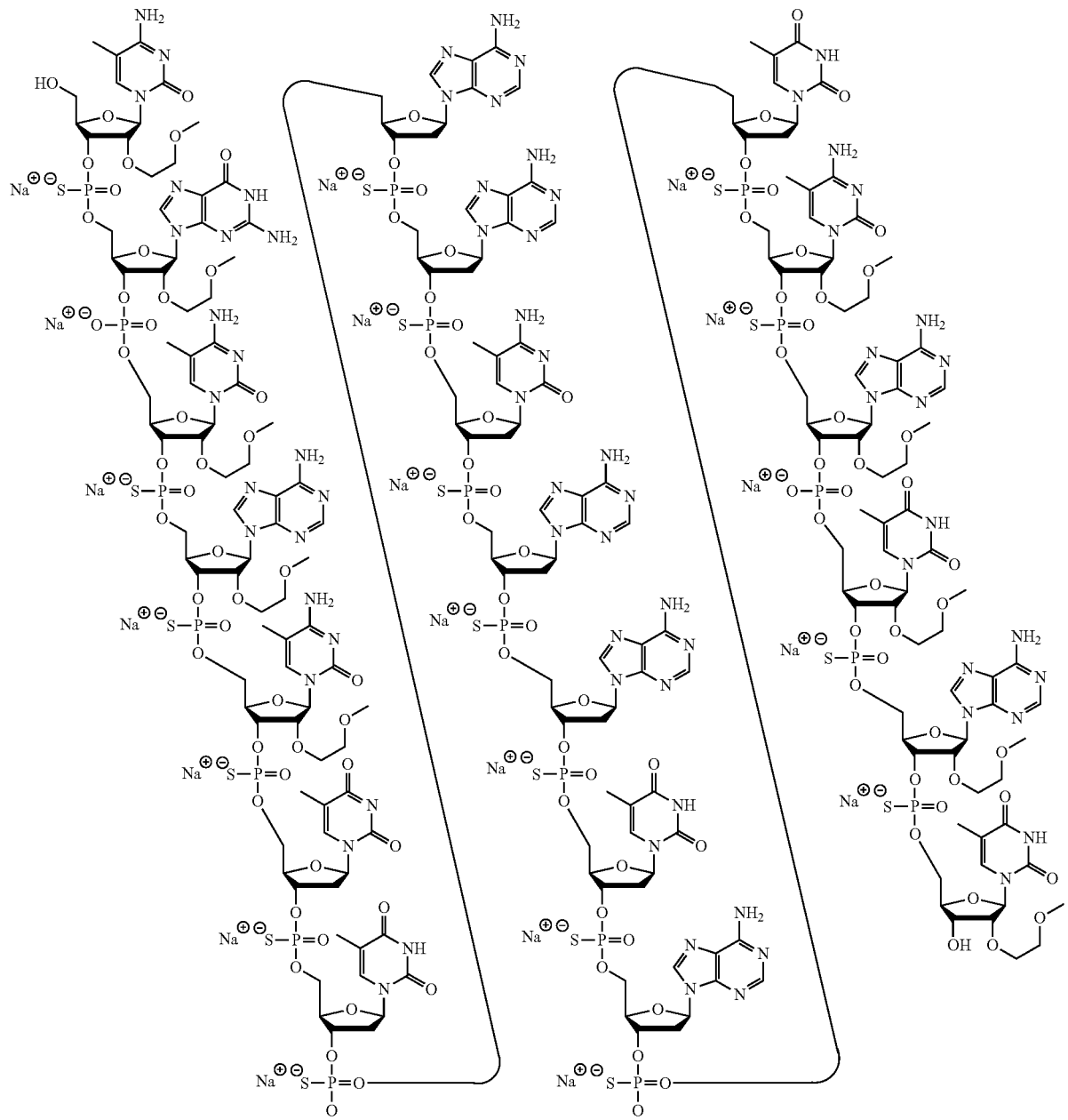

(SEQ ID NO: 852).

Embodiment 50. A chirally enriched population of the modified oligonucleotide of any of embodiments 37-49 wherein the population is enriched for modified oligonucleotides comprising at least one particular phosphorothioate internucleoside linkage having a particular stereochemical configuration.

Embodiment 51. The chirally enriched population of embodiment 50, wherein the population is enriched for a modified oligonucleotide comprising at least one particular phosphorothioate internucleoside linkage having the (Sp) configuration.

Embodiment 52. The chirally enriched population of embodiment 50 or 51, wherein the population is enriched for modified oligonucleotides having at least one particular phosphorothioate internucleoside linkage having the (Rp) configuration.

Embodiment 53. The chirally enriched population of embodiment 50, wherein the population is enriched for modified oligonucleotides having a particular, independently selected stereochemical configuration at each phosphorothioate internucleoside linkage Embodiment 54. The chirally enriched population of embodiment 53, wherein the population is enriched for modified oligonucleotides having the (Sp) configuration at each phosphorothioate internucleoside linkage.

Embodiment 55. The chirally enriched population of embodiment 53, wherein the population is enriched for modified oligonucleotides having the (Rp) configuration at each phosphorothioate internucleoside linkage.

Embodiment 56. The chirally enriched population of embodiment 50 or embodiment 53 wherein the population is enriched for modified oligonucleotides having at least 3 contiguous phosphorothioate internucleoside linkages in the Sp-Sp-Rp configuration, in the 5' to 3' direction.

Embodiment 57. A population of modified oligonucleotides of any of embodiments 37-49, wherein all of the phosphorothioate internucleoside linkages of the modified oligonucleotide are stereorandom.

Embodiment 58. A pharmaceutical composition comprising the modified oligonucleotide of any of embodiments 37-49 and a pharmaceutically acceptable diluent or carrier.

Embodiment 59. The pharmaceutical composition of embodiment 58, wherein the pharmaceutically acceptable diluent is artificial cerebrospinal fluid.

Embodiment 60. The pharmaceutical composition of embodiment 59, wherein the pharmaceutical composition consists essentially of the modified oligonucleotide and artificial cerebrospinal fluid.

Embodiment 61. A method comprising administering to an animal a pharmaceutical composition of any of embodiments 36 or 58-60.

Embodiment 62. A method of treating a disease associated with LRRK2 comprising administering to an individual having or at risk for developing a disease associated with LRRK2 a therapeutically effective amount of a pharmaceutical composition according to any of embodiments 36 or 58-60; and thereby treating the disease associated with LRRK2.

Embodiment 63. The method of embodiment 62, wherein the disease associated with LRRK2 is a neurodegenerative disease.

Embodiment 64. The method of embodiment 63, wherein the neurodegenerative disease is Parkinson's disease.
Embodiment 65. The method of embodiment 64, wherein at least one symptom or hallmark of the neurodegenerative disease is ameliorated.

Embodiment 66. The method of embodiment 65, wherein the symptom or hallmark is any of ataxia, neuropathy, and aggregate formation.

Embodiment 67. An oligomeric compound comprising a modified oligonucleotide according to the following formula:

Ges mCeo Teo mCeo Aes Tds Ads Tds mCds Tds
       Ads Ads Ads Gds Ads mCeo mCeo Ges mCes
       Ae (SEQ ID NO: 222); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 68. An oligomeric compound comprising a modified oligonucleotide according to the following formula:

Tes mCeo Aeo mCeo mCes Ads mCds Ads Ads Ads
       mCds Tds mCds Ads Tds Geo Geo Aes mCes
       Te (SEQ ID NO: 888); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 69. An oligomeric compound comprising a modified oligonucleotide according to the following formula:

Aes mCeo mCeo mCeo Tes Tds Tds mCds mCds
       Ads Tds Gds Tds Gds Ads Aeo mCeo Aes Tes
       Te (SEQ ID NO: 1431); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 70. An oligomeric compound comprising a modified oligonucleotide according to the following formula:

Aes mCeo Geo mCeo Aes mCds Tds Tds Ads Ads
       mCds Ads Ads Tds Ads Teo mCeo Aes Tes Ae
       (SEQ ID NO: 3590); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 71. An oligomeric compound comprising a modified oligonucleotide according to the following formula: Aes Geo mCeo Aeo Aes Tds mCds Ads Tds Tds Gds Gds Tds Ads Gds mCeo Aeo Tes Aes mCe (SEQ ID NO: 3385); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 72. An oligomeric compound comprising a modified oligonucleotide according to the following formula: mCes Geo mCes Aes mCes Tds Tds Ads Ads mCds Ads Ads Tds Ads Tds mCes Aeo Tes Aes Te (SEQ ID NO: 852); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 73. The oligomeric compound of embodiment 3, wherein the modified oligonucleotide is an RNAi compound.

Embodiment 74. The oligomeric compound of embodiment 73, wherein the RNAi compound is an ssRNA or an siRNA.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.).

In certain embodiments, a 2'-substituted non-bicyclic modified nucleoside comprises a sugar moiety comprising a non-bridging 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside non-bicyclic modified nucleoside comprises a sugar moiety comprising a non-bridging 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted non-bicyclic modified nucleoside comprises a sugar moiety comprising a non-bridging 2'-substituent group selected from: F, OCH$_3$, and OCH$_2$CH$_2$OCH$_3$.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O-2' (referred to as "constrained ethyl" or "cEt"), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., *J. Org. Chem.*, 2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O- 2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129, 8362-8379; Wengel et a., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

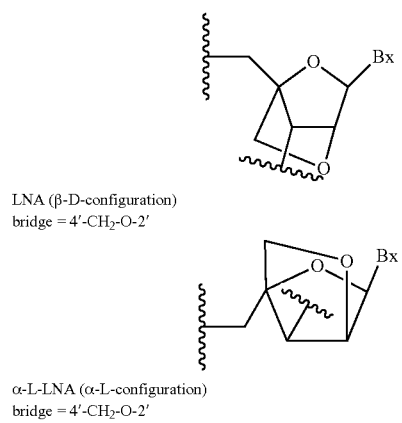

LNA (β-D-configuration)
bridge = 4'-CH$_2$-O-2'

α-L-LNA (α-L-configuration)
bridge = 4'-CH$_2$-O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

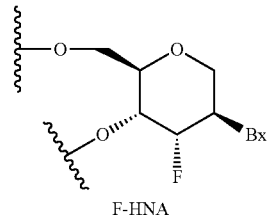

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

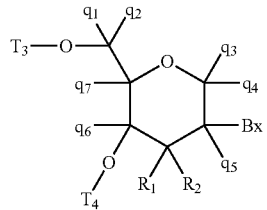

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

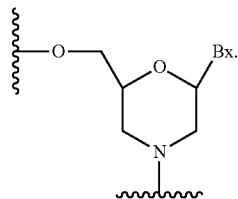

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp) Modified nucleobases may also include those in which the purine or pyrimidine base is replaced with other heterocycles, for example 7-deazaadenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manohara et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include but are not limited to methylenemethylimino (—CH$_2$—N(CH$_3$)—O—CH$_2$—), thiodiester, thionocarbamate (—O—C(=O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

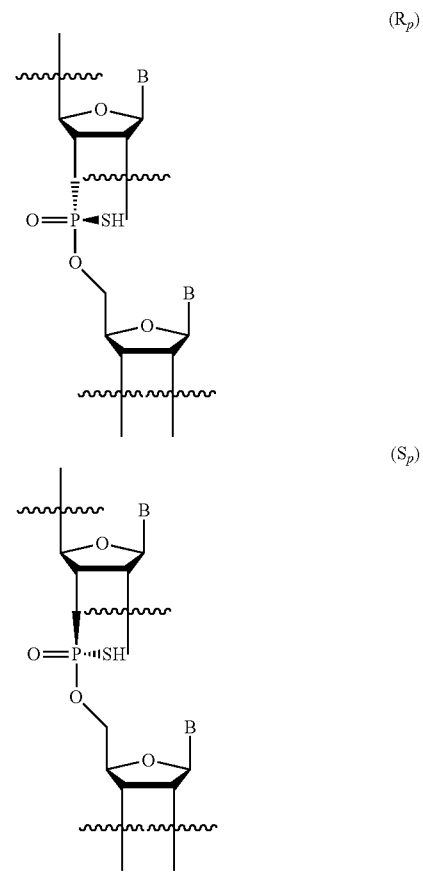

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-CH$_2$—N(CH$_3$)—O-5'), amide-3 (3'-CH$_2$—C(=O)—N(H)-5'), amide-4 (3'-CH$_2$—N(H)—C(=O)-5'), formacetal (3'-O—CH$_2$—O-5'), methoxypropyl, and thioformacetal (3'-S—CH$_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and CH$_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, each nucleoside of each wing of a gapmer is a modified nucleoside. In certain embodiments, at least one nucleoside of each wing of a gapmer is a modified nucleoside. In certain embodiments, at least two nucleosides of each wing of a gapmer are modified nucleosides. In certain embodiments, at least three nucleosides of each wing of a gapmer are modified nucleosides. In certain embodiments, at least four nucleosides of each wing of a gapmer are modified nucleosides.

In certain embodiments, the gap of a gapmer comprises 7-12 nucleosides. In certain embodiments, each nucleoside of the gap of a gapmer is an unmodified 2'-deoxy nucleoside. In certain embodiments, at least one nucleoside of the gap of a gapmer is a modified nucleoside.

In certain embodiments, the gapmer is a deoxy gapmer. In certain embodiments, the nucleosides on the gap side of each wing/gap junction are unmodified 2'-deoxy nucleosides and the nucleosides on the wing sides of each wing/gap junction are modified nucleosides. In certain embodiments, each nucleoside of the gap is an unmodified 2'-deoxy nucleoside. In certain embodiments, each nucleoside of each wing of a gapmer is a modified nucleoside.

In certain embodiments, modified oligonucleotides comprise or consist of a region having a fully modified sugar motif. In such embodiments, each nucleoside of the fully modified region of the modified oligonucleotide comprises a modified sugar moiety. In certain embodiments, each nucleoside of the entire modified oligonucleotide comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

Herein, the lengths (number of nucleosides) of the three regions of a gapmer may be provided using the notation [# of nucleosides in the 5'-wing]-[# of nucleosides in the gap]-[# of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in each sugar moiety of each wing and the gap nucleosides comprise unmodified deoxynucleosides sugars. Thus, a 5-10-5 MOE gapmer consists of 5 linked MOE modified nucleosides in the 5'-wing, 10 linked deoxynucleosides in the gap, and 5 linked MOE nucleosides in the 3'-wing.

In certain embodiments, modified oligonucleotides are 5-10-5 MOE gapmers. In certain embodiments, modified oligonucleotides are 3-10-3 BNA gapmers. In certain embodiments, modified oligonucleotides are 3-10-3 cEt gapmers. In certain embodiments, modified oligonucleotides are 3-10-3 LNA gapmers.

2. Certain Nucleobase Motifs

In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P=O). In certain embodiments, each internucleoside linking group of a modified oligonucleotide is a phosphorothioate internucleoside linkage (P=S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target RNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides D. Certain Modified Oligonucleotides In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a region of an oligonucleotide has a nucleobase sequence that is complementary to a second oligonucleotide or an identified reference nucleic acid, such as a target nucleic acid. In certain embodiments, the nucleobase sequence of a region or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., *Proc. Natl. Acad. Sci. USA*, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., *Ann. N.Y. Acad. Sci.*, 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e.g., do-decan-diol or undecyl residues (Saison-Behmoaras et al., *EMBO J.*, 1991, 10, 1111-1118; Kabanov et al., *FEBS Lett.*, 1990, 259, 327-330; Svinarchuk et al., *Biochimie*, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic acid a palmityl moiety (Mishra et al., *Biochim. Biophys. Acta*, 1995, 1264, 229-237), an octadecylamine or hexylamino-carbonyl-oxycholesterol moiety (Crooke et al., *J. Pharmacol. Exp. Ther.*, 1996, 277, 923-937), a tocopherol group (Nishina et al., *Molecular Therapy Nucleic Acids*, 2015, 4, e220; and Nishina et al., *Molecular Therapy*, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

B. Certain Terminal Groups

In certain embodiments, oligomeric compounds comprise one or more terminal groups. In certain such embodiments, oligomeric compounds comprise a stabilized 5'-phophate. Stabilized 5'-phosphates include, but are not limited to 5'-phosphanates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a region complementary to a target nucleic acid and a second oligomeric compound having a region complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or animal V. Certain Target Nucleic Acids In certain embodiments, oligomeric compounds comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target RNA is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron. In certain embodiments, the target nucleic acid is the RNA transcriptional product of a retrogene. In certain embodiments, the target nucleic acid is a non-coding RNA. In certain such embodiments, the target non-coding RNA is selected from: a long non-coding RNA, a short non-coding RNA, an intronic RNA molecule.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the mRNA to reduce the expression of both bcl-2 and in vitro and in vivo. Furthermore, this oligonucleotide demonstrated potent antitumor activity in vivo. Maher and Dolnick (Nuc. Acid. Res. 16:3341-3358, 1988) tested a series of tandem 14 nucleobase oligonucleotides, and a 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a region that is 100% or fully complementary to a target nucleic acid. In certain embodiments, the region of full complementarity is from 6 to 20, 10 to 18, or 18 to 20 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved.

In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. LRRK2

In certain embodiments, oligomeric compounds comprise or consist of an oligonucleotide comprising a region that is complementary to a target nucleic acid, wherein the target nucleic acid is LRRK2. In certain embodiments, LRRK2 nucleic acid has the sequence set forth in SEQ ID NO: 1 (GENBANK Accession No: NM_198578.3) and SEQ ID NO: 2 (GENBANK Accession No: NT_029419.11 truncated from nucleotides 2759000 to 2909000).

In certain embodiments, contacting a cell with an oligomeric compound complementary to SEQ ID NO: 1 or SEQ ID NO: 2 reduces the amount of LRRK2 RNA, and in certain embodiments reduces the amount of LRRK2 protein. In certain embodiments, the oligomeric compound consists of a modified oligonucleotide. In certain embodiments, contacting a cell with an oligomeric compound complementary to SEQ ID NO: 1 or SEQ ID NO: 2 ameliorates one or more symptom or hallmark of a neurodegenerative disease. In certain embodiments, the oligomeric compound consists of a modified oligonucleotide. In certain embodiments, the symptom or hallmark is ataxia, neuropathy, and aggregate formation. In certain embodiments, contacting a cell with a modified oligonucleotide complementary to SEQ ID NO: 1 or SEQ ID NO: 2 results in improved motor function, reduced neuropathy, and reduction in number of aggregates. In certain embodiments, the oligomeric compound consists of a modified oligonucleotide C. Certain Target Nucleic Acids in Certain Tissues In certain embodiments, oligomeric compounds comprise or consist of an oligonucleotide comprising a region that is complementary to a target nucleic acid, wherein the target nucleic acid is expressed in a pharmacologically relevant tissue. In certain embodiments, the pharmacologically relevant tissues are the cells and tissues that comprise the central nervous system (CNS). Such tissues include brain tissues, such as, cortex, substantia nigra, striatum, midbrain, and brainstem and spinal cord.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to an animal, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Under certain conditions, certain compounds disclosed herein act as acids. Although such compounds may be drawn or described in protonated (free acid) form, in ionized (anion) form, or ionized and in association with a cation (salt) form, aqueous solutions of such compounds exist in equilibrium among such forms. For example, a phosphate linkage of an oligonucleotide in aqueous solution exists in equilibrium among free acid, anion, and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or salts thereof" expressly includes all such forms that may be fully or partially protonated/de-protonated/in association with a cation. In certain instances, one or more specific cation is identified.

In certain embodiments, oligomeric compounds disclosed herein are in aqueous solution with sodium. In certain embodiments, oligomeric compounds are in aqueous solution with potassium. In certain embodiments, oligomeric compounds are in acritical CSF. In certain embodiments, oligomeric compounds are in PBS. In certain embodiments, oligomeric compounds are in water. In certain such embodiments, the pH of the solution is adjusted with NaOH and/or HCl to achieve a desired pH.

VII. Certain Compositions

1. Compound No: 780241 Compound No: 780241 may be characterized as a 5-10-5 MOE gapmer having a sequence of (from 5' to 3') GCTCATATCTAAAGACCGCA (incorporated herein as SEQ ID NO: 222), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 780241 may be characterized by the following chemical notation: Ges mCeo Teo mCeo Aes Tds Ads Tds mCds Tds Ads Ads Ads Gds Ads mCeo mCeo Ges mCes Ae; wherein, A=an adenine nucleobase, mC=a 5-methyl cytosine nucleobase, G=a guanine nucleobase, T=a thymine nucleobase, e=a 2'-MOE modified sugar, d=a 2'-deoxyribose sugar, s=a phosphorothioate internucleoside linkage, and o=a phosphodiester internucleoside linkage.

Compound No: 780241 may be represented by the following chemical structure:
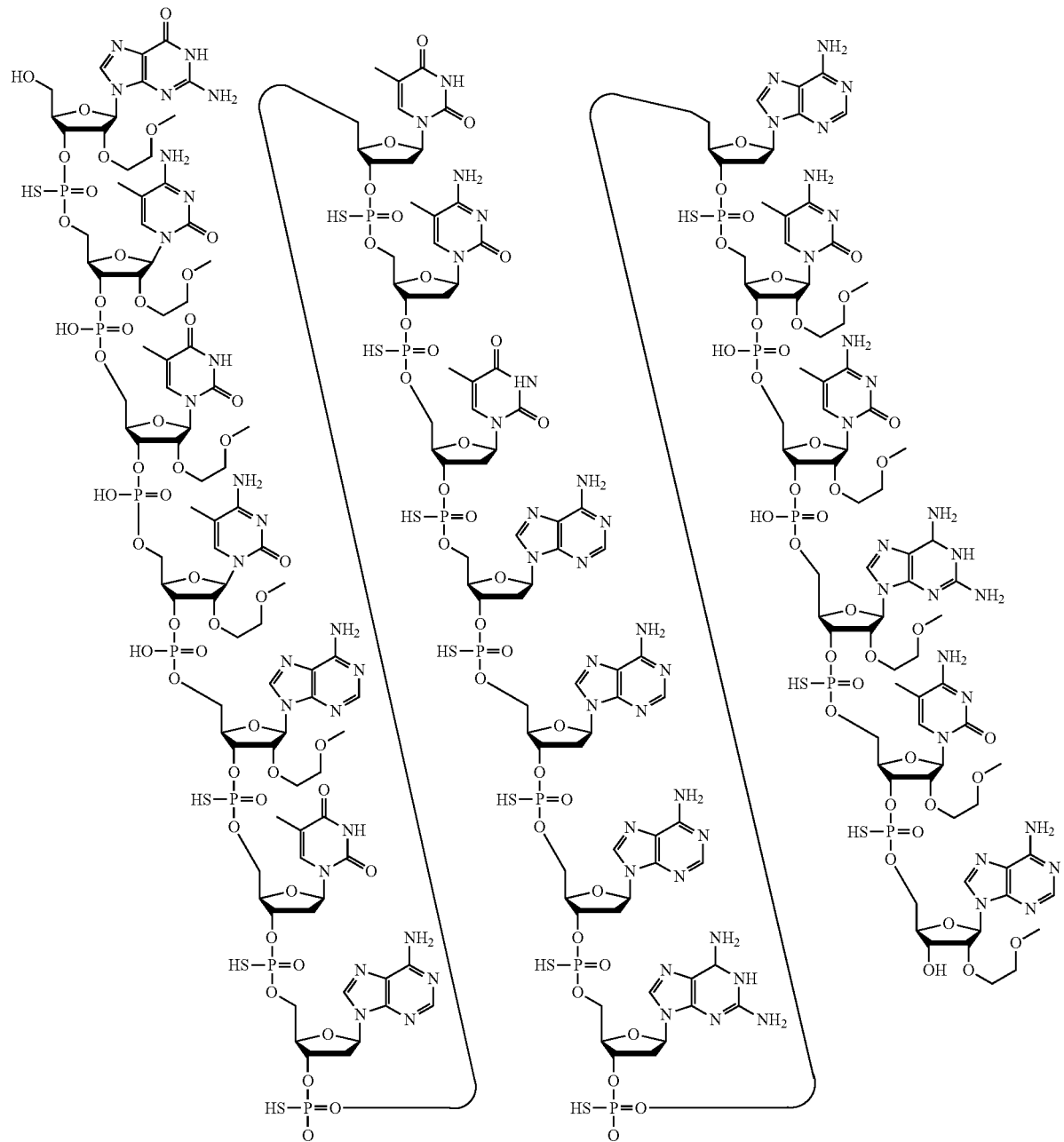

Structure 1. Compound No: 780241 (SEQ ID NO: 222).

Compound No: 780241 may be represented by the following chemical structure:

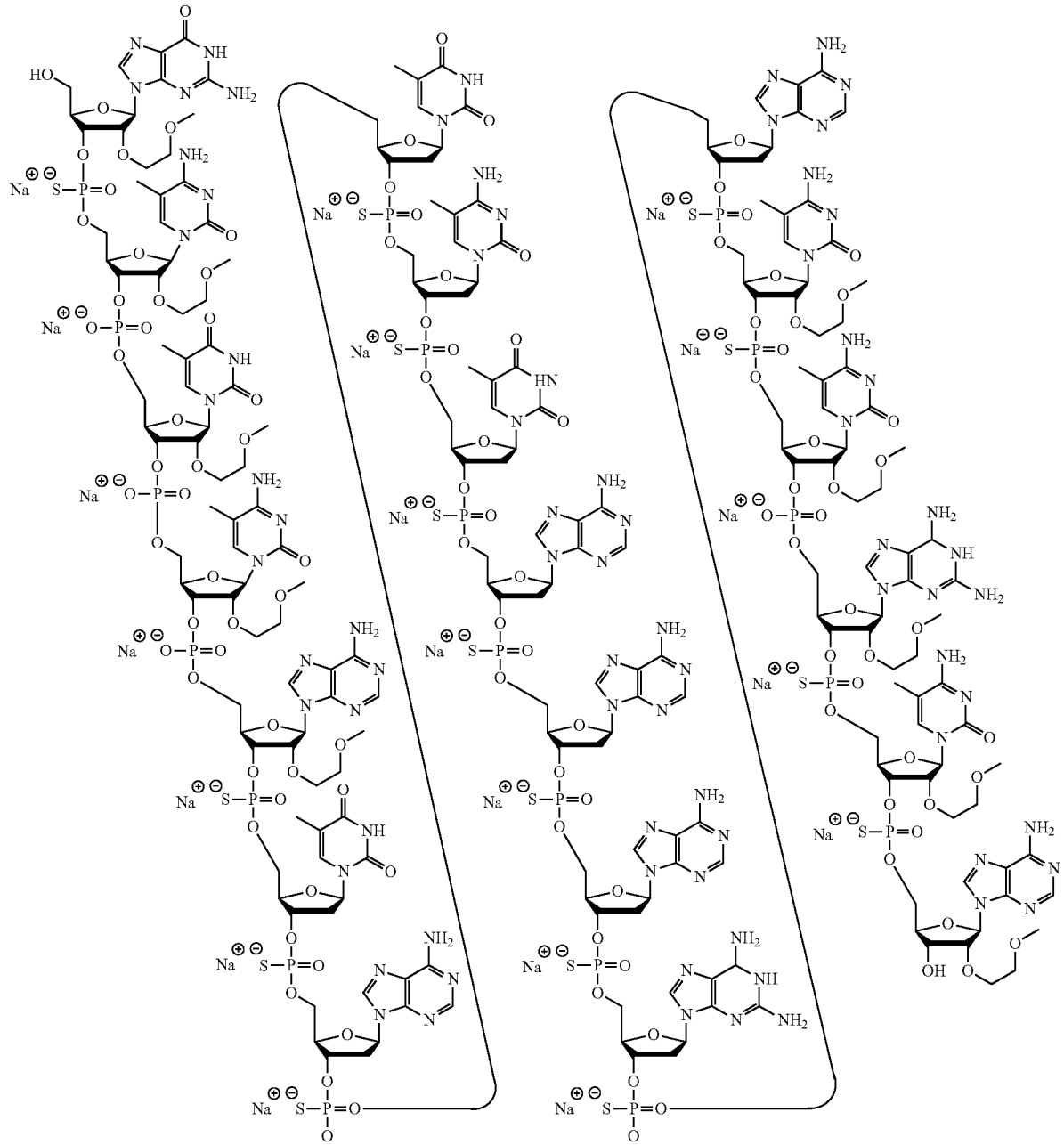

Structure 2. The Sodium salt of Compound No: 780241 (SEQ ID NO: 222).

2. Compound No: 802714

Compound No: 802714 may be characterized as a 5-10-5 MOE gapmer, having a sequence of (from 5' to 3') TCAC-CACAAACTCATGGACT (incorporated herein as SEQ ID NO: 888), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 802714 may be characterized by the following chemical notation: Tes mCeo Aeo mCeo mCes Ads mCds Ads Ads Ads mCds Tds mCds Ads Tds Geo Geo Aes mCes Te; wherein,
  A=an adenine nucleobase,
  mC=a 5-methyl cytosine nucleobase,
  G=a guanine nucleobase,
  T=a thymine nucleobase,
  e=a 2'-MOE modified sugar,
  d=a 2'-deoxyribose sugar,
  s=a phosphorothioate internucleoside linkage, and
  o=a phosphodiester internucleoside linkage.

Compound No: 802714 may be represented by the following chemical structure:

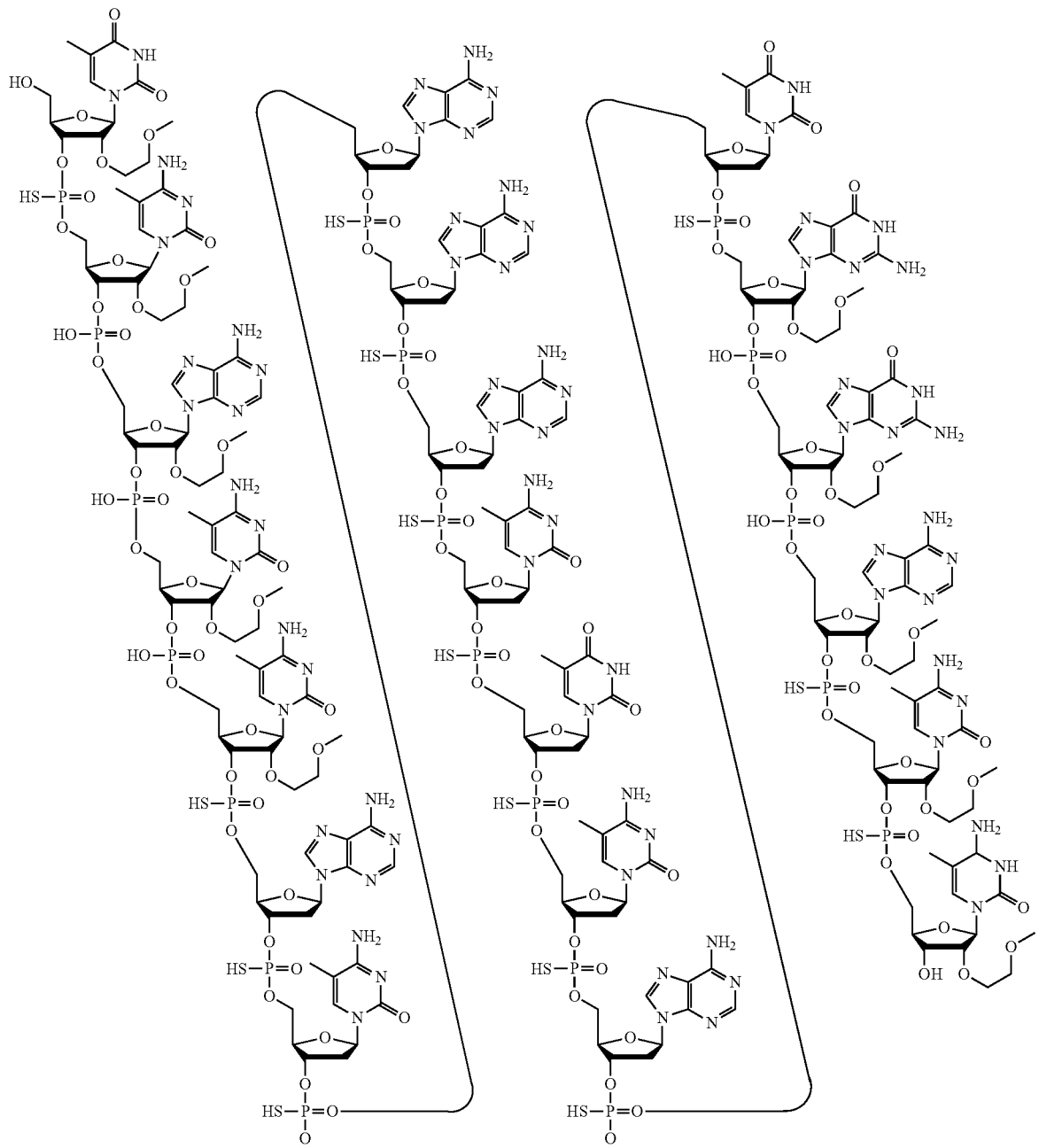

Structure 3. Compound No: 802714 (SEQ ID NO: 888).

Compound No: 802714 may be represented by the following chemical structure:

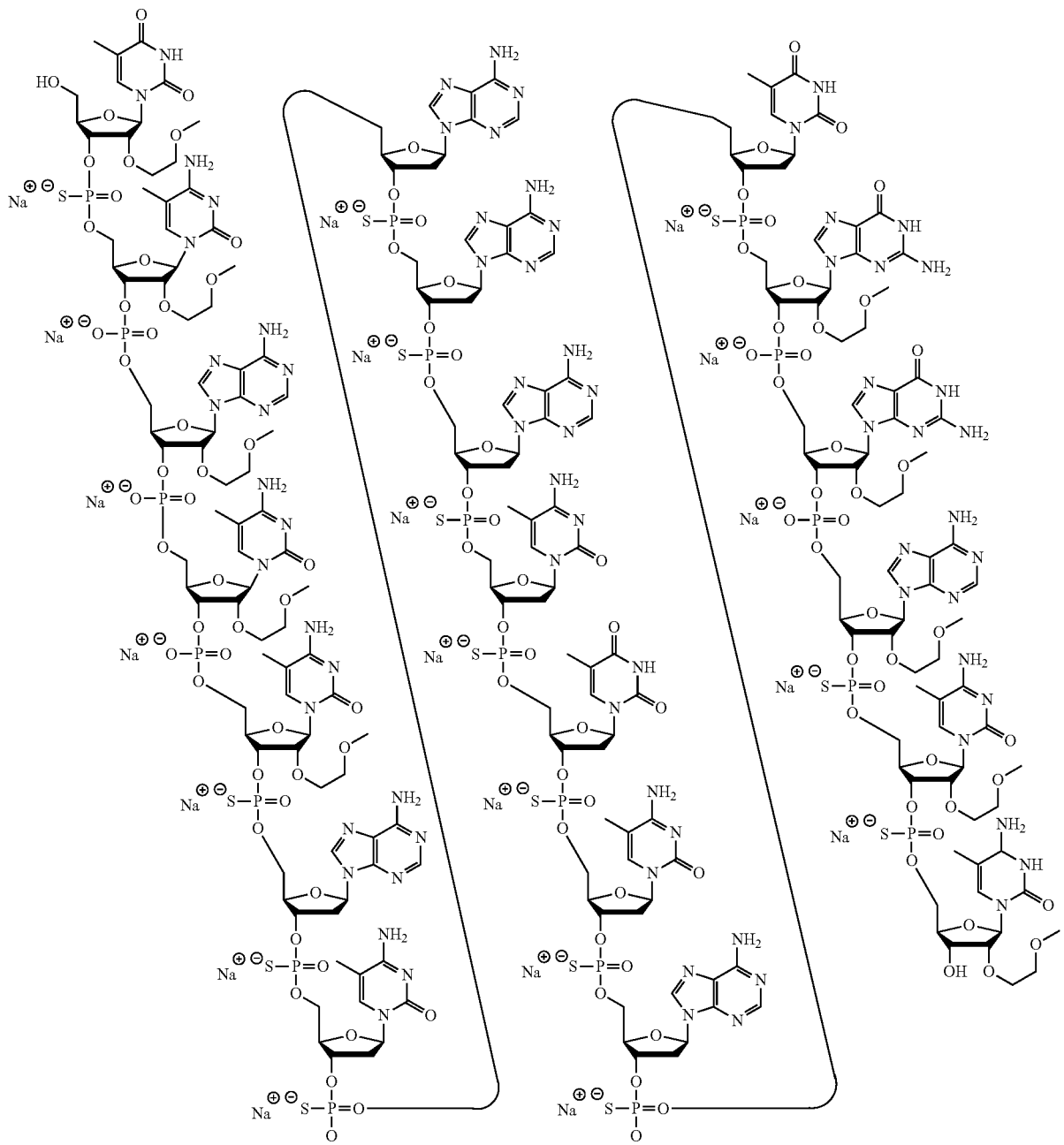

Structure 4. The Sodium salt of Compound No: 802714 (SEQ ID NO: 888).

3. Compound No: 803268

Compound No: 803268 may be characterized as a 5-10-5 MOE gapmer, having a sequence of (from 5' to 3') ACCCTTTCCATGTGAACATT (incorporated herein as SEQ ID NO: 1431), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 803268 may be characterized by the following chemical notation: Aes mCeo mCeo mCeo Tes Tds Tds mCds mCds Ads Tds Gds Tds Gds Ads Aeo mCeo Aes Tes Te; wherein, A=an adenine nucleobase, mC=a 5-methyl cytosine nucleobase, G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.
Compound No: 803268 may be represented by the following chemical structure:
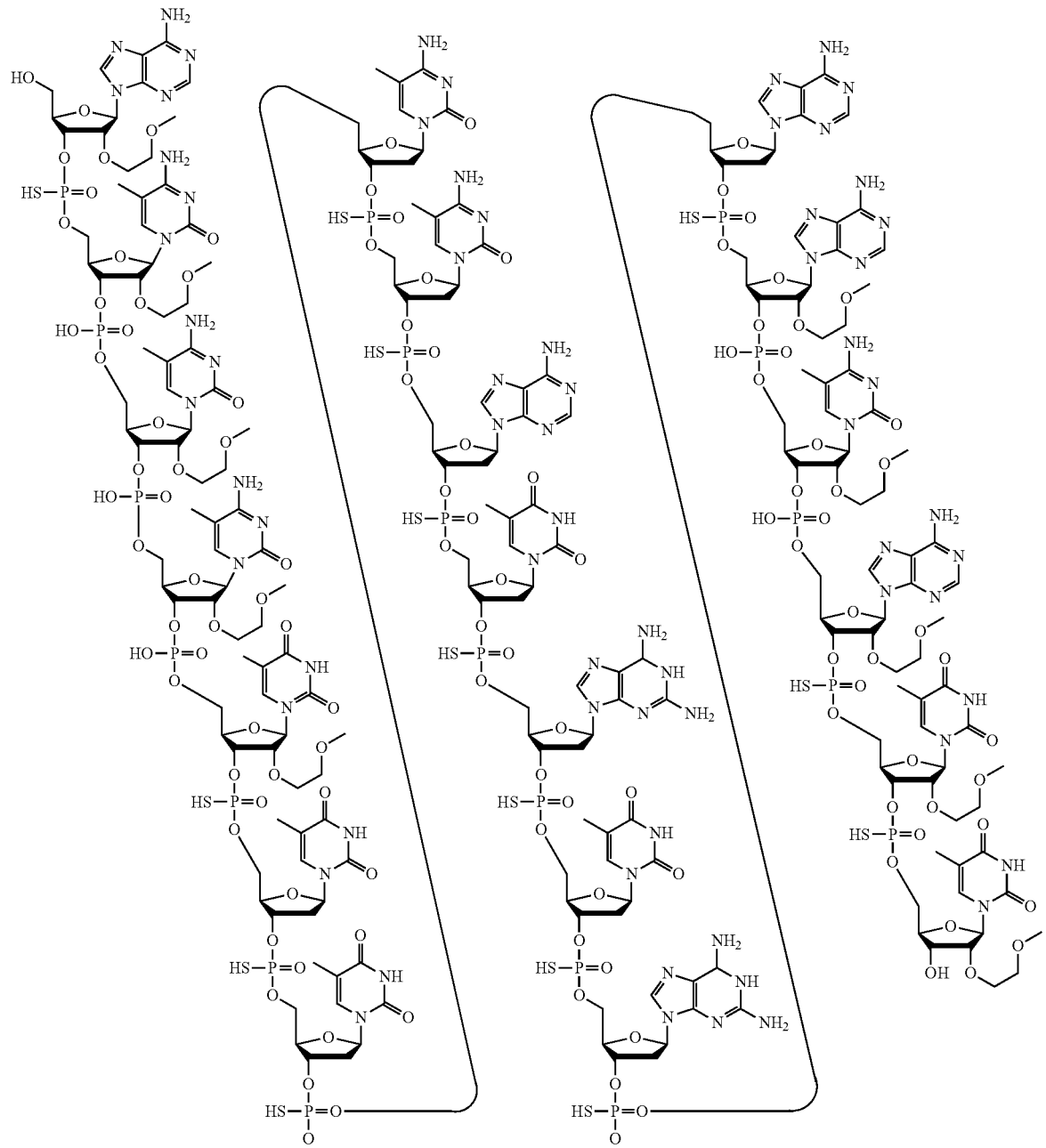

Structure 5. Compound No: 803268 (SEQ ID NO: 1431).

Compound No: 803268 may be represented by the following chemical structure:

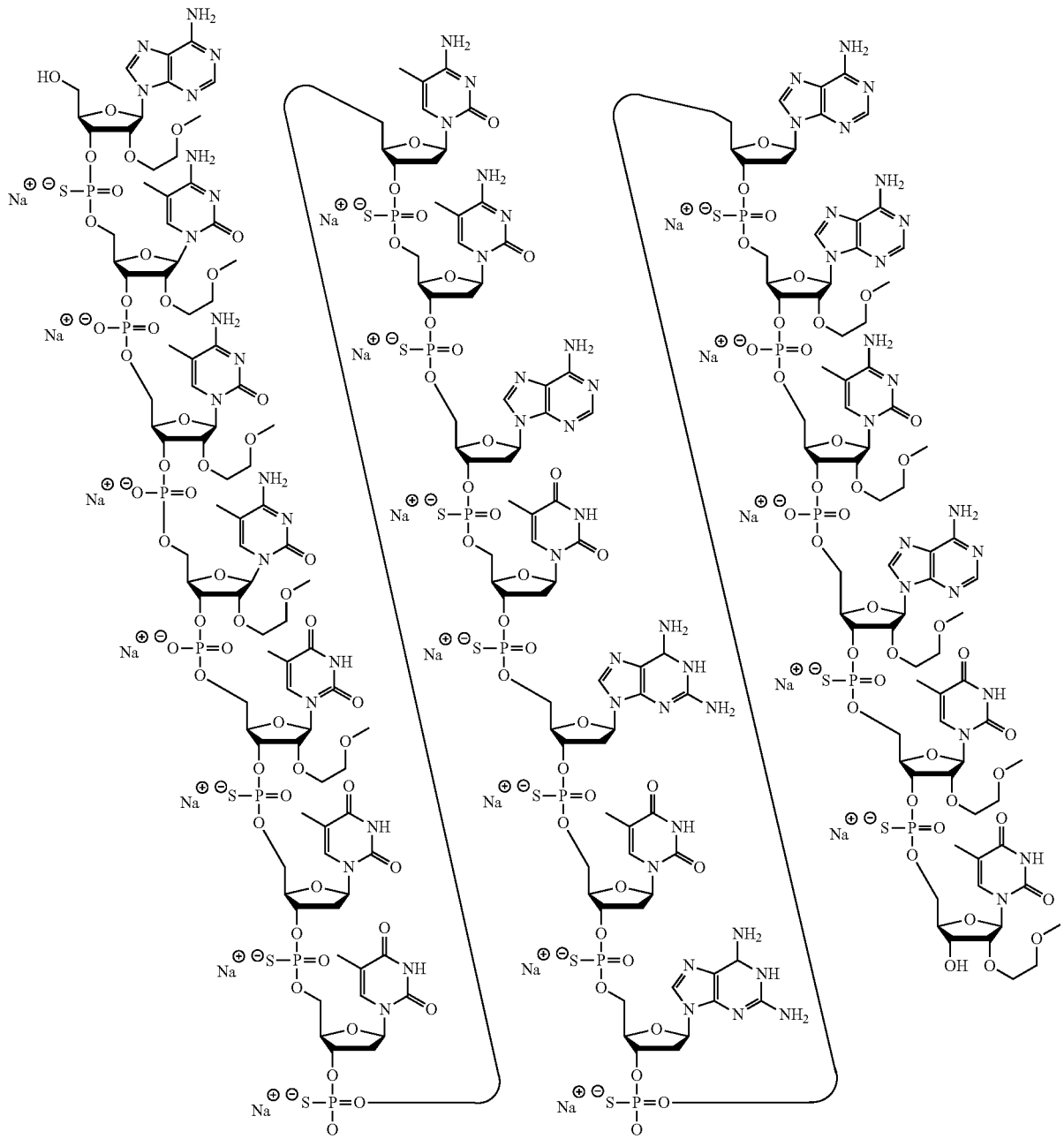

Structure 6. The Sodium salt of Compound No: 803268 (SEQ ID NO: 1431).

4. Compound No: 876031

Compound No: 876031 may be characterized as a 5-10-5 MOE gapmer, having a sequence of (from 5' to 3') ACGCACTTAACAATATCATA (incorporated herein as SEQ ID NO: 3590), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 876031 may be characterized by the following chemical notation: Aes mCeo Geo mCeo Aes mCds Tds Tds Ads Ads mCds Ads Ads Tds Ads Teo mCeo Aes Tes Ae; wherein, A=an adenine nucleobase, mC=a 5-methyl cytosine nucleobase, G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.
Compound No: 876031 may be represented by the following chemical structure:
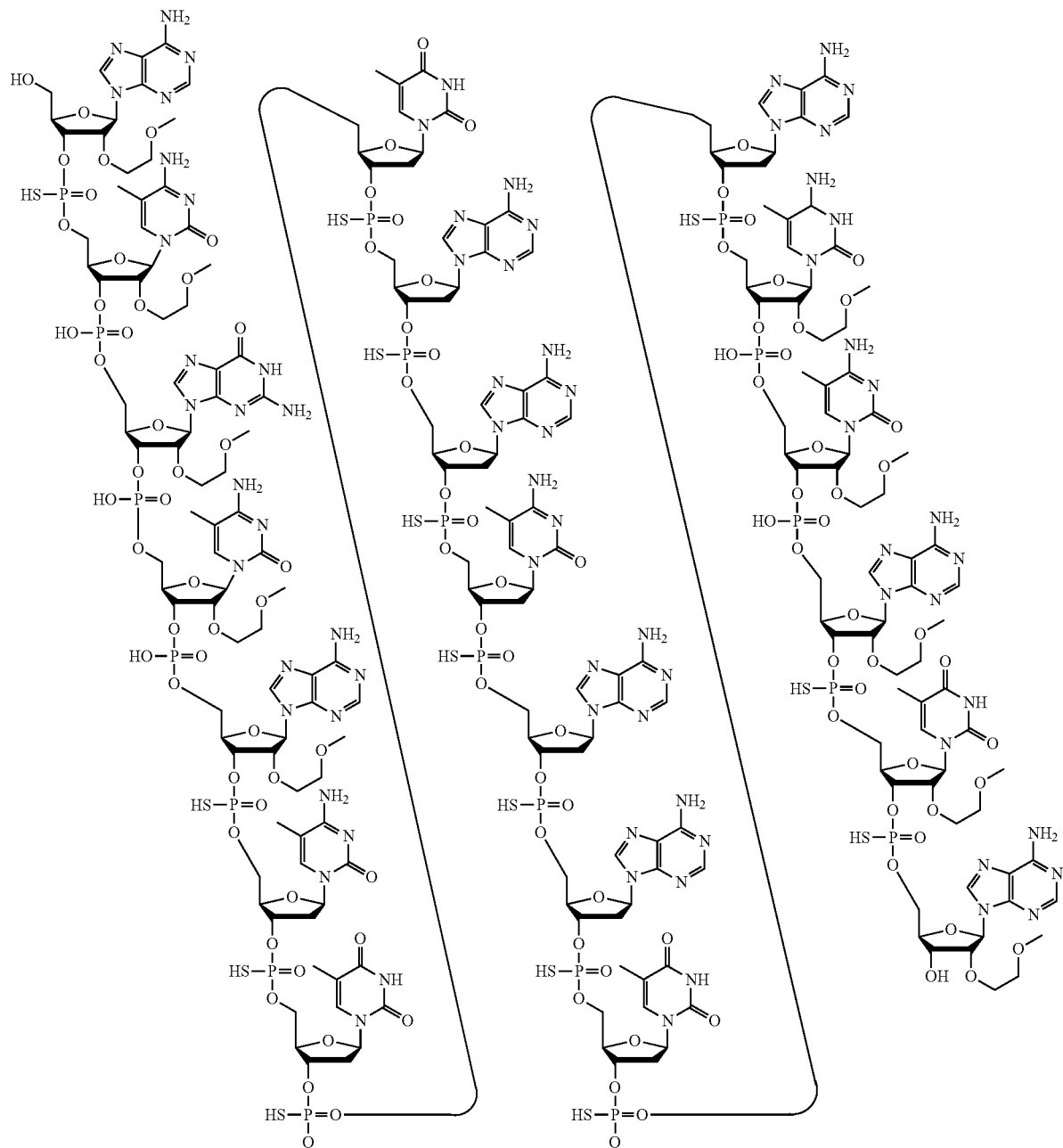

Structure 7. Compound No: 876031 (SEQ ID NO: 3590).

Compound No: 876031 may be represented by the following chemical structure:

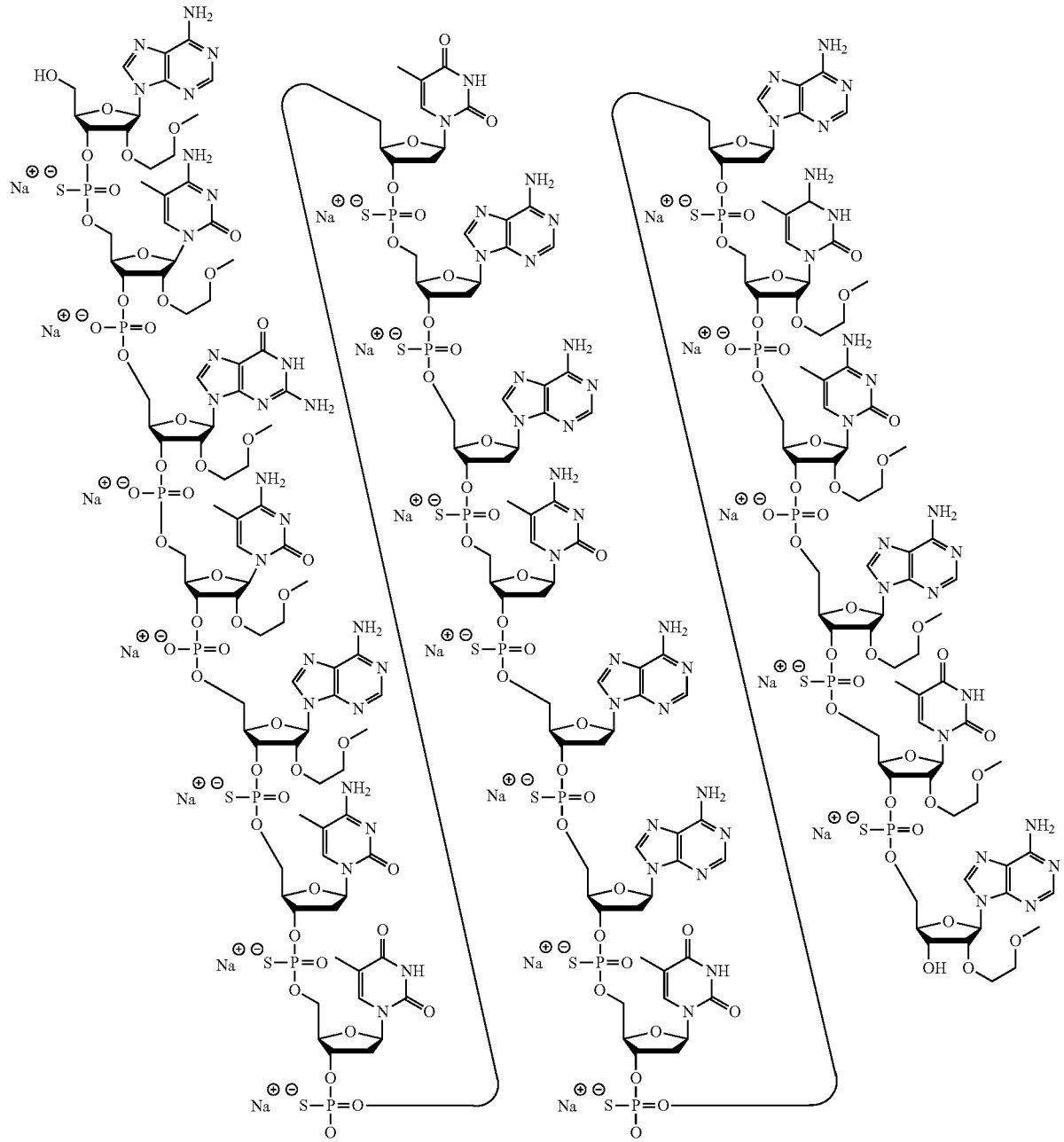

Structure 8. The Sodium salt of Compound No: 876031 (SEQ ID NO: 3590).

5. Compound No: 876604

Compound No: 876604 may be characterized as a 5-10-5 MOE gapmer, having a sequence of (from 5' to 3') AGCAATCATTGGTAGCATAC (incorporated herein as SEQ ID NO: 3385), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 876604 may be characterized by the following chemical notation: Aes Geo mCeo Aeo Aes Tds mCds Ads Tds Tds Gds Gds Tds Ads Gds mCeo Aeo Tes Aes mCe; wherein, A=an adenine nucleobase, mC=a 5-methyl cytosine nucleobase, G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.
Compound No: 876604 may be represented by the following chemical structure:
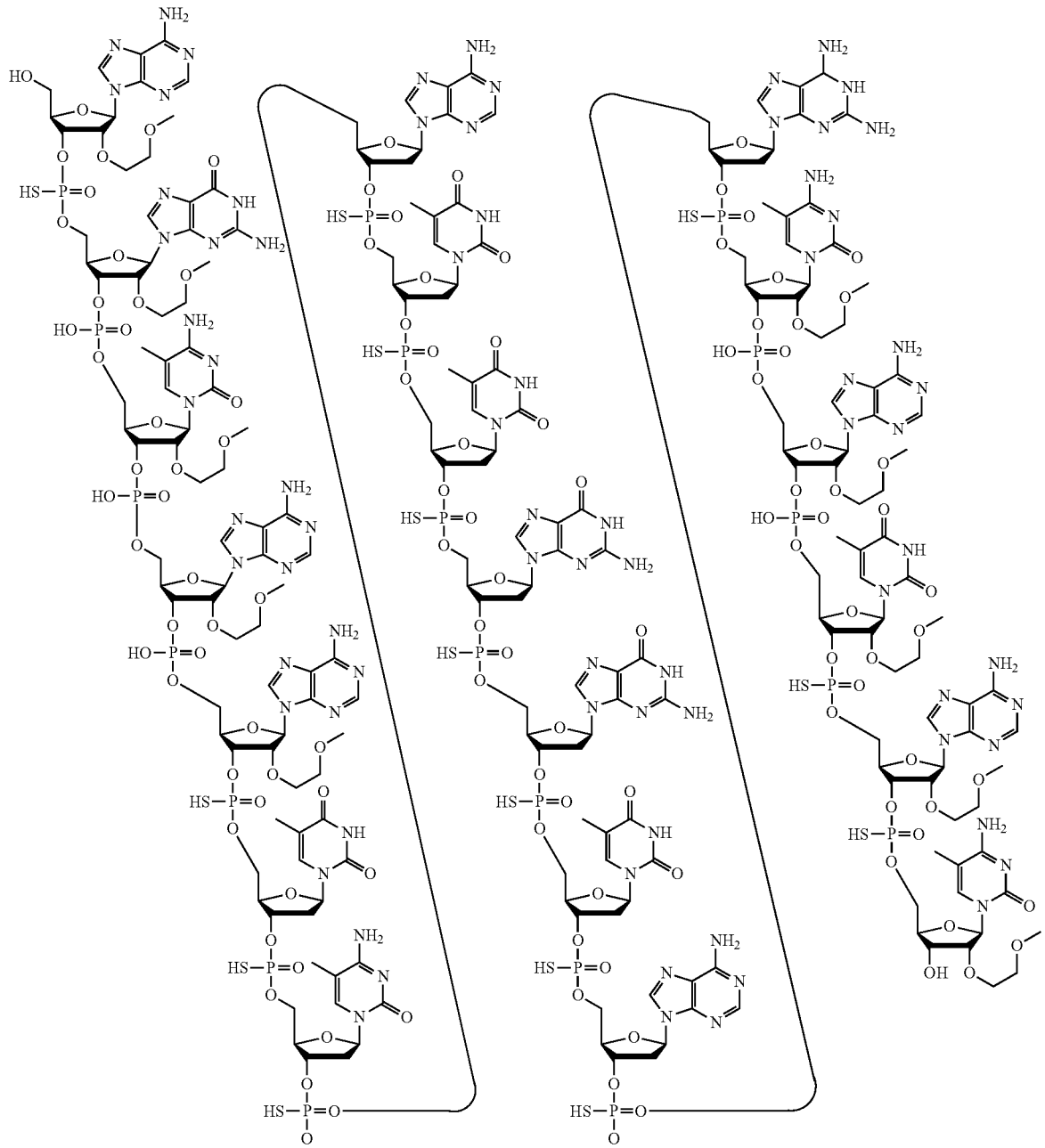

Structure 8. Compound No: 876604 (SEQ ID NO: 3385).

Compound No: 876604 may be represented by the following chemical structure:

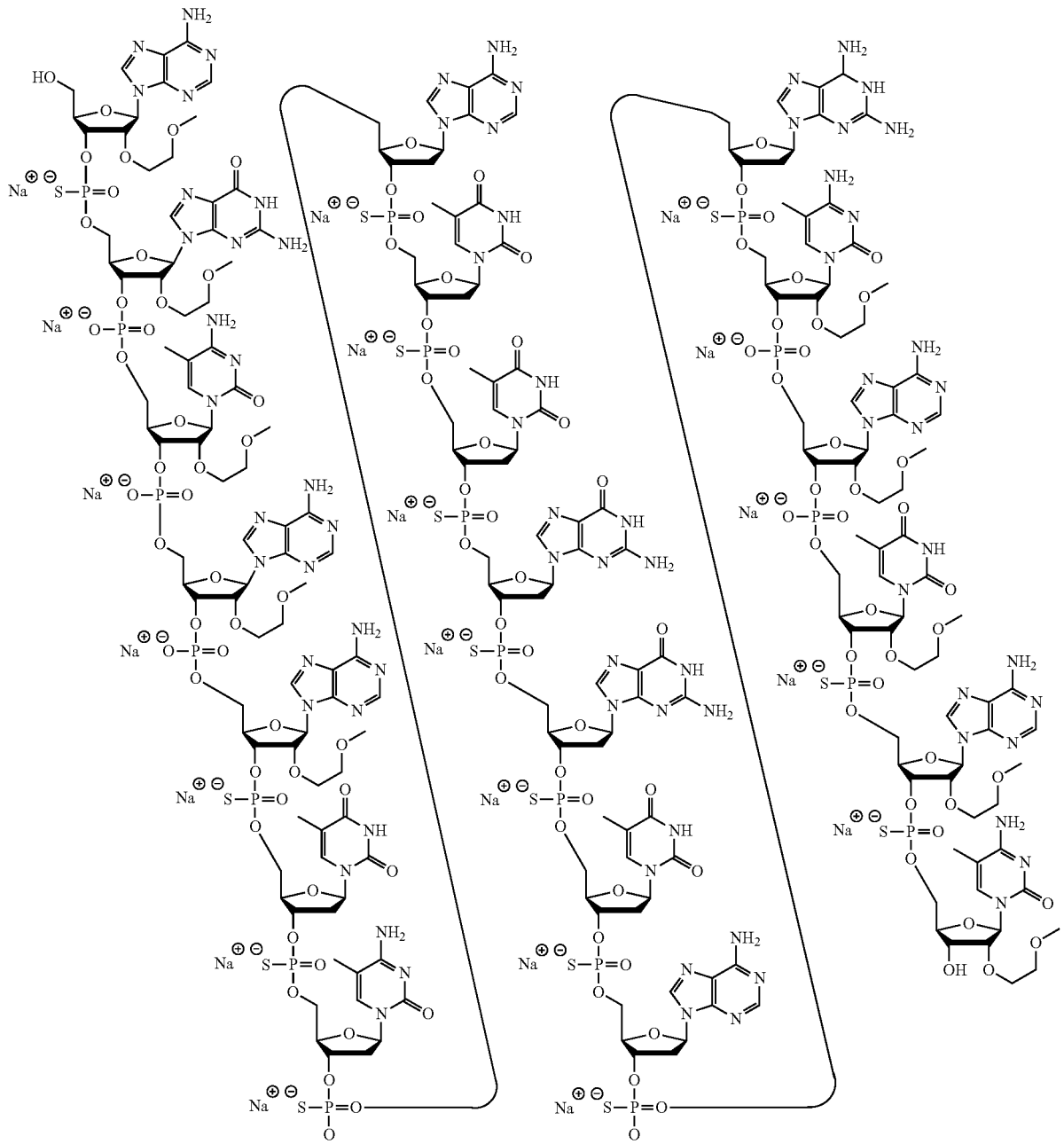

Structure 10. The Sodium Salt of Compound No: 876604 (SEQ ID NO: 3385).

6. Compound No: 934556

Compound No: 934556 may be characterized as a 5-10-5 MOE gapmer, having a sequence of (from 5' to 3') CGCACTTAACAATATCATAT (incorporated herein as SEQ ID NO: 852), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3 and 17 to 18 are phosphodiester internucleoside linkages and the internucleoside linkages between nucleosides 1 to 2, 3 to 4, 4 to 5, 5 to 6, 6 to 7, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

Compound No: 934556 may be characterized by the following chemical notation: mCes Geo mCes Aes mCes Tds Tds Ads Ads mCds Ads Ads Tds Ads Tds mCes Aeo Tes Aes Te; wherein, A=an adenine nucleobase, mC=a 5-methyl cytosine nucleobase, G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.
Compound No: 934556 may be represented by the following chemical structure:
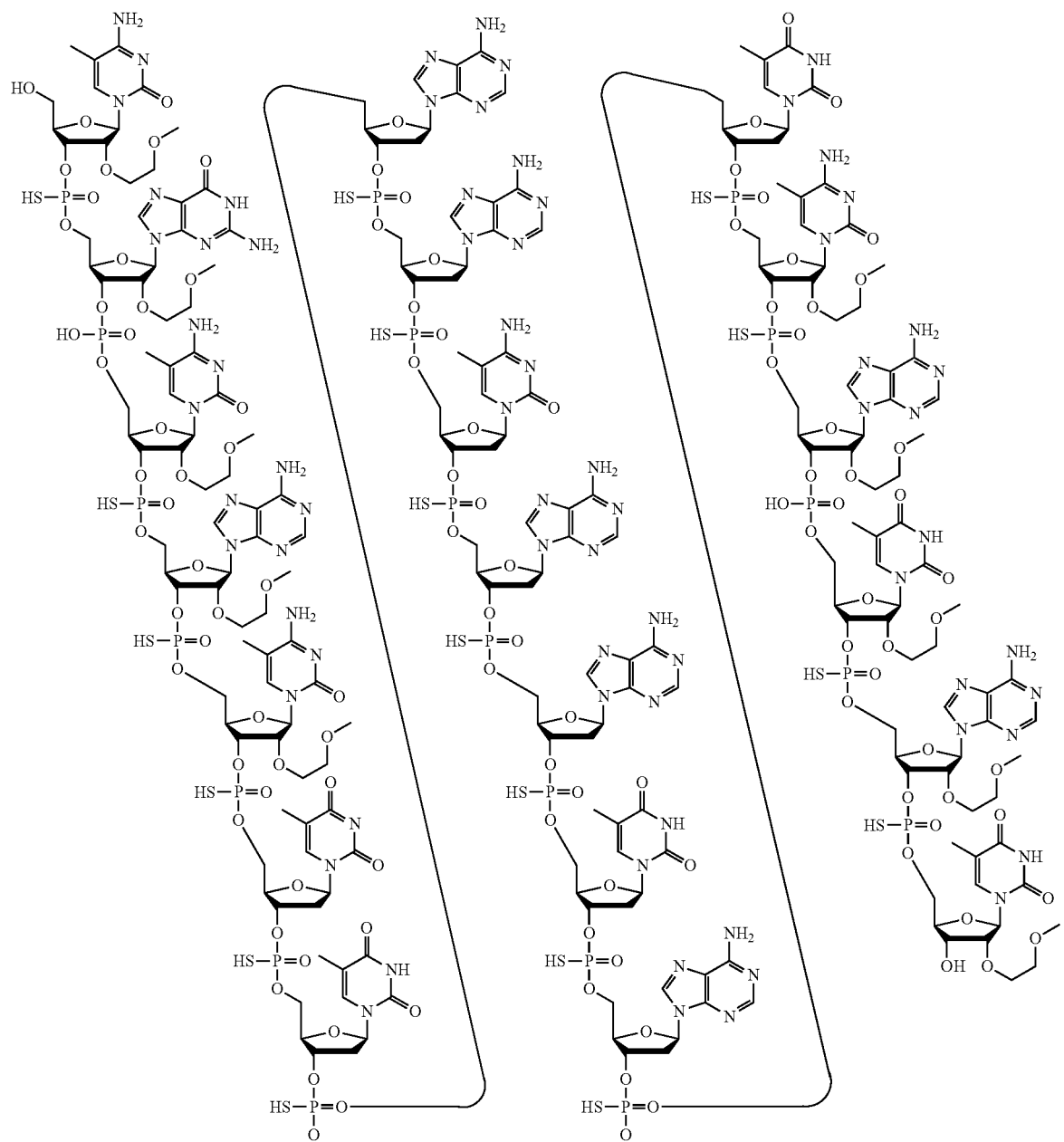

Structure 11. Compound No: 934556 (SEQ ID NO: 852).
Compound No: 934556 may be represented by the following chemical structure:

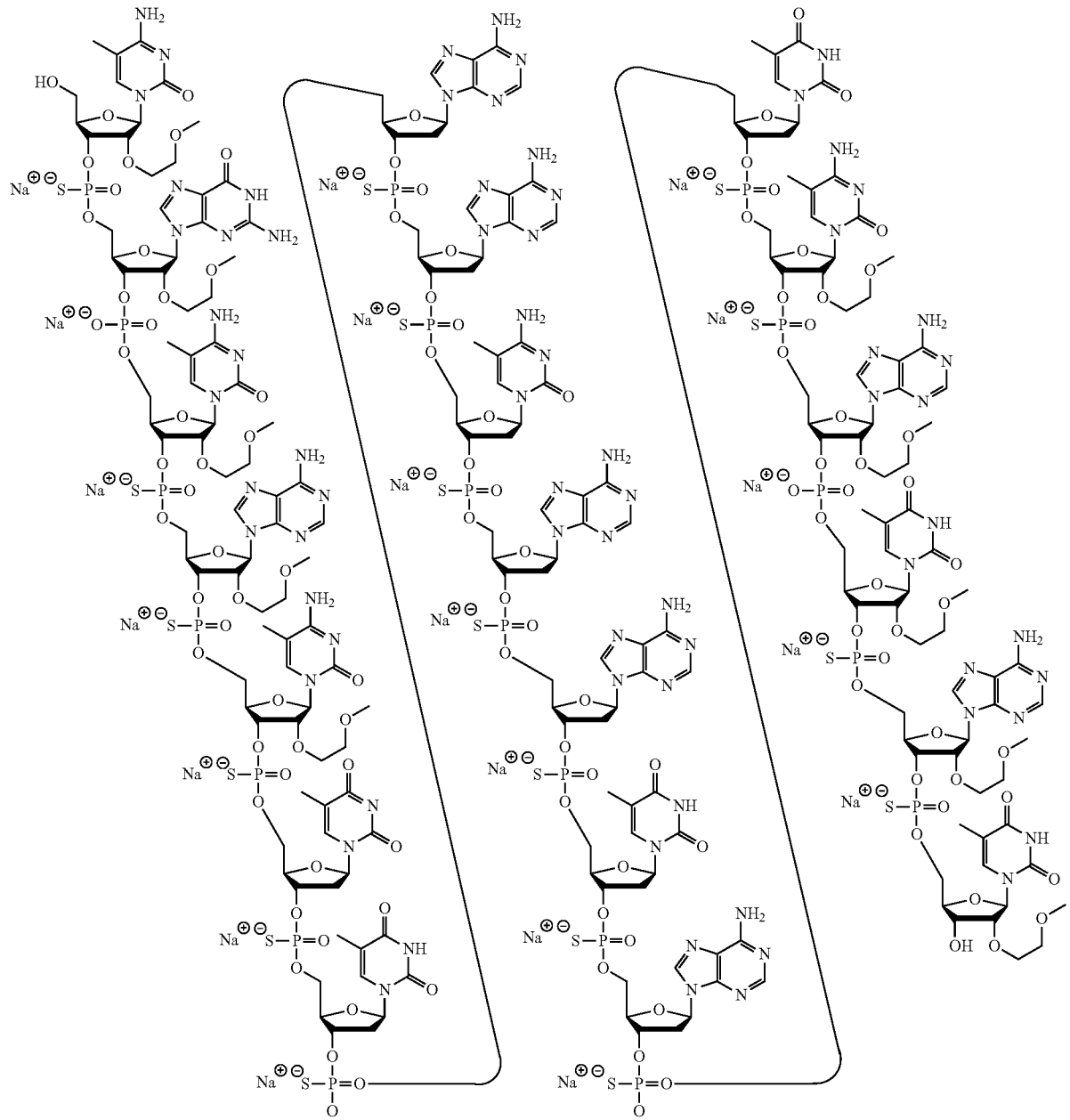

Structure 12. The Sodium salt of Compound No: 934556 (SEQ ID NO: 852).

VIII. Certain Hotspot Regions
1. Nucleobases 18,633-18,658 of SEQ ID NO: 2

In certain embodiments, nucleobases 18,633-18,658 of SEQ ID NO: 2 comprise a hotspot region. In certain embodiments, siRNAs are complementary to nucleobases 18,633-18,658 of SEQ ID NO: 2. In certain embodiments, modified oligonucleotides are complementary to nucleobases 18,633-18,658 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssooss.

The nucleobase sequences of SEQ ID Nos: 852, 1997, 2073, 2148, 3513, and 3590 are complementary to nucleobases 18,633-18,658 of SEQ ID NO: 2.

In certain embodiments, modified oligonucleotides complementary to nucleobases 18,633-18,658 of SEQ ID NO: 2 achieve at least 54% reduction of LRRK2 RNA in vitro in at least one single dose assay.

2. Nucleobases 21,721-21,755 of SEQ ID NO: 2

In certain embodiments, nucleobases 21,721-21,755 of SEQ ID NO: 2 comprise a hotspot region. In certain embodiments, siRNAs are complementary to nucleobases 21,721-21,755 of SEQ ID NO: 2. In certain embodiments, modified oligonucleotides are complementary to nucleobases 21,721-21,755 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 291, 869, 870, 871, 872, 873, 874, 875, 876, 877, 878, 879, and 880 are complementary to nucleobases 21,721-21,755 of SEQ ID NO: 2.

In certain embodiments, modified oligonucleotides complementary to nucleobases 21,721-21,755 of SEQ ID NO: 2 achieve at least 52% reduction of LRRK2 RNA in vitro in at least one single dose assay.

3. Nucleobases 27,963-28,016 of SEQ ID NO: 2

In certain embodiments, nucleobases 27,963-28,016 of SEQ ID NO: 2 comprise a hotspot region. In certain embodiments, siRNAs are complementary to nucleobases 27,963-28,016 of SEQ ID NO: 2. In certain embodiments, modified oligonucleotides are complementary to nucleobases 27,963-28,016 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 293, 886, 887, 888, 889, 890, 891, 892, 893, and 3745 are complementary to nucleobases 27,963-28,016 of SEQ ID NO: 2.

In certain embodiments, modified oligonucleotides complementary to nucleobases 27,963-28,016 of SEQ ID NO: 2 achieve at least 39% reduction of LRRK2 RNA in vitro in at least one single dose assay.

4. Nucleobases 35,415-35,446 of SEQ ID NO: 2

In certain embodiments, nucleobases 35,415-35,446 of SEQ ID NO: 2 comprise a hotspot region. In certain embodiments, siRNAs are complementary to nucleobases 35,415-35,446 of SEQ ID NO: 2. In certain embodiments, modified oligonucleotides are complementary to nucleobases 35,415-35,446 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 920, 921, 2378, 2454, 2530, 2606, 2683, 2759, 2835, 3061, 3137, 3212, and 3288 are complementary to nucleobases 35,415-35,446 of SEQ ID NO: 2.

In certain embodiments, modified oligonucleotides complementary to nucleobases 35,415-35,446 of SEQ ID NO: 2 achieve at least 42% reduction of LRRK2 RNA in vitro in at least one single dose assay.

5. Nucleobases 77,221-77,264 of SEQ ID NO: 2

In certain embodiments, nucleobases 77,221-77,264 of SEQ ID NO: 2 comprise a hotspot region. In certain embodiments, siRNAs are complementary to nucleobases 77,221-77,264 of SEQ ID NO: 2. In certain embodiments, modified oligonucleotides are complementary to nucleobases 77,221-77,264 of SEQ ID NO: 2. In certain embodiments, modified oligonucleotides are 20 nucleobases in length. In certain embodiments, modified oligonucleotides are gapmers.

In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 131, 217, 1106, 1107, and 1108 are complementary to nucleobases 77,221-77,264 of SEQ ID NO: 2.

In certain embodiments, modified oligonucleotides complementary to nucleobases 77,221-77,264 of SEQ ID NO: 2 achieve at least 51% reduction of LRRK2 RNA in vitro in at least one single dose assay.

6. Nucleobases 81,581-81,612 and 87,838-87,869 of SEQ ID NO: 2

In certain embodiments, nucleobases 81,581-81,612 and 87,838-87,869 of SEQ ID NO: 2 comprise a hotspot region. In certain embodiments, siRNAs are complementary to nucleobases 81,581-81,612 and 87,838-87,869 of SEQ ID NO: 2. In certain embodiments, modified oligonucleotides are complementary to nucleobases 81,581-81,612 and 87,838-87,869 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 667, 668, 669, 670, 671, 1785, 1786, 1787, 1788, 1789, 1790, 1791, and 1792 are complementary to nucleobases 81,581-81,612 and 87,838-87,869 of SEQ ID NO: 2.

In certain embodiments, modified oligonucleotides complementary to nucleobases 81,581-81,612 and 87,838-87,869 of SEQ ID NO: 2 achieve at least 38% reduction of LRRK2 RNA in vitro in at least one single dose assay.

7. Nucleobases 81,627-81,651 of SEQ ID NO: 2

In certain embodiments, nucleobases 81,627-81,651 of SEQ ID NO: 2 comprise a hotspot region. In certain embodiments, siRNAs are complementary to nucleobases 81,627-81,651 of SEQ ID NO: 2. In certain embodiments, modified oligonucleotides are complementary to nucleobases 81,627-81,651 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 674, 1799, 1800, 1801, 1802, and 1803 are complementary to nucleobases 81,627-81,651 of SEQ ID NO: 2.

In certain embodiments, modified oligonucleotides complementary to nucleobases 81,627-81,651 of SEQ ID NO: 2 achieve at least 66% reduction of LRRK2 RNA in vitro in at least one single dose assay.

8. Nucleobases 82,058-82,081 of SEQ ID NO: 2

In certain embodiments, nucleobases 82,058-82,081 of SEQ ID NO: 2 comprise a hotspot region. In certain embodiments, siRNAs are complementary to nucleobases 82,058-82,081 of SEQ ID NO: 2. In certain embodiments, modified oligonucleotides are complementary to nucleobases 82,058-82,081 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 222, 1130, 1131, 1132, and 1133 are complementary to nucleobases 82,058-82,081 of SEQ ID NO: 2.

In certain embodiments, modified oligonucleotides complementary to nucleobases 82,058-82,081 of SEQ ID NO: 2 achieve at least 53% reduction of LRRK2 RNA in vitro in at least one single dose assay.

9. Nucleobases 82,180-82,220 of SEQ ID NO: 2

In certain embodiments, nucleobases 82,180-82,220 of SEQ ID NO: 2 comprise a hotspot region. In certain embodiments, siRNAs are complementary to nucleobases 82,180-82,220 of SEQ ID NO: 2. In certain embodiments, modified oligonucleotides are complementary to nucleobases 82,180-82,220 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 225, 1145, 2005, 2840, 3369, 3446, 3521, 3598, and 3674 are complementary to nucleobases 82,180-82,220 of SEQ ID NO: 2.

In certain embodiments, modified oligonucleotides complementary to nucleobases 82,180-82,220 of SEQ ID NO: 2 achieve at least 64% reduction of LRRK2 RNA in vitro in at least one single dose assay.

10. Nucleobases 82,500-82,525 of SEQ ID NO: 2

In certain embodiments, nucleobases 82,500-82,525 of SEQ ID NO: 2 comprise a hotspot region. In certain embodiments, siRNAs are complementary to nucleobases 82,500-82,525 of SEQ ID NO: 2. In certain embodiments, modified oligonucleotides are complementary to nucleobases 82,500-82,525 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 439, 1807, 1808, 1809, 1810, 1811, and 1812 are complementary to nucleobases 82,500-82,525 of SEQ ID NO: 2.

In certain embodiments, modified oligonucleotides complementary to nucleobases 82,500-82,525 of SEQ ID NO: 2 achieve at least 49% reduction of LRRK2 RNA in vitro in at least one single dose assay.

11. Nucleobases 91,038-91,067 of SEQ ID NO: 2

In certain embodiments, nucleobases 91,038-91,067 of SEQ ID NO: 2 comprise a hotspot region. In certain embodiments, siRNAs are complementary to nucleobases 91,038-91,067 of SEQ ID NO: 2. In certain embodiments, modified oligonucleotides are complementary to nucleobases 91,038-91,067 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 692, 1826, 1827, 1828, 1829, 1830, 1831, 1832, 1833, 1834, and 1835 are complementary to nucleobases 91,038-91,067 of SEQ ID NO: 2.

The modified oligonucleotides of Compound Nos: 780642, 803664, 803665, 803666, 803667, 803668, 803669, 803670, 803671, 803672, and 803673 are complementary to nucleobases 91,038-91,067 of SEQ ID NO: 2.

In certain embodiments, modified oligonucleotides complementary to nucleobases 91,038-91,067 of SEQ ID NO: 2 achieve at least 42% reduction of LRRK2 RNA in vitro in at least one single dose assay.

12. Nucleobases 92,148-92,173 of SEQ ID NO: 2

In certain embodiments, nucleobases 92,148-92,173 of SEQ ID NO: 2 comprise a hotspot region. In certain embodiments, siRNAs are complementary to nucleobases 92,148-92,173 of SEQ ID NO: 2. In certain embodiments, modified oligonucleotides are complementary to nucleobases 92,148-92,173 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 1213, 2613, 2690, 3143, 3219, and 3295 are complementary to nucleobases 92,148-92,173 of SEQ ID NO: 2.

In certain embodiments, modified oligonucleotides complementary to nucleobases 92,148-92,173 of SEQ ID NO: 2 achieve at least 59% reduction of LRRK2 RNA in vitro in at least one single dose assay.

13. Nucleobases 98,186-98,220 of SEQ ID NO: 2

In certain embodiments, nucleobases 98,186-98,220 of SEQ ID NO: 2 comprise a hotspot region. In certain embodiments, siRNAs are complementary to nucleobases 98,186-98,220 of SEQ ID NO: 2. In certain embodiments, modified oligonucleotides are complementary to nucleobases 98,186-98,220 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 1231, 1232, 2462, 2538, 2614, 2691, 2767, 3069, 3144, 3220, 3296 are complementary to nucleobases 98,186-98,220 of SEQ ID NO: 2.

In certain embodiments, modified oligonucleotides complementary to nucleobases 98,186-98,220 of SEQ ID NO: 2 achieve at least 55% reduction of LRRK2 RNA in vitro in at least one single dose assay.

14. Nucleobases 98,218-98,242 of SEQ ID NO: 2

In certain embodiments, nucleobases 98,218-98,242 of SEQ ID NO: 2 comprise a hotspot region. In certain embodiments, siRNAs are complementary to nucleobases 98,218-98,242 of SEQ ID NO: 2. In certain embodiments, modified oligonucleotides are complementary to nucleobases 98,218-98,242 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 150, 1233, 2008, 3372, 3449, and 3524 are complementary to nucleobases 98,218-98,242 of SEQ ID NO: 2.

In certain embodiments, modified oligonucleotides complementary to nucleobases 98,218-98,242 of SEQ ID NO: 2 achieve at least 38% reduction of LRRK2 RNA in vitro in at least one single dose assay.

15. Nucleobases 99,199-99,223 of SEQ ID NO: 2

In certain embodiments, nucleobases 99,199-99,223 of SEQ ID NO: 2 comprise a hotspot region. In certain embodiments, siRNAs are complementary to nucleobases 99,199-99,223 of SEQ ID NO: 2. In certain embodiments, modified oligonucleotides are complementary to nucleobases 99,199-99,223 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 1243, 2311, 2387, 2920, 2995, and 3755 are complementary to nucleobases 99,199-99,223 of SEQ ID NO: 2.

In certain embodiments, modified oligonucleotides complementary to nucleobases 99,199-99,223 of SEQ ID NO: 2 achieve at least 52% reduction of LRRK2 RNA in vitro in at least one single dose assay.

16. Nucleobases 119,903-119,936 of SEQ ID NO: 2

In certain embodiments, nucleobases 119,903-119,936 of SEQ ID NO: 2 comprise a hotspot region. In certain embodiments, siRNAs are complementary to nucleobases 119,903-119,936 of SEQ ID NO: 2. In certain embodiments, modified oligonucleotides are complementary to nucleobases 119,903-119,936 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 750, 1927, 1928, 1929, 1930, 1931, 1932, 1933, 1934, 1935, 2822, 2898, 3351, and 3733 are complementary to nucleobases 119,903-119,936 of SEQ ID NO: 2.

In certain embodiments, modified oligonucleotides complementary to nucleobases 119,903-119,936 of SEQ ID NO: 2 achieve at least 51% reduction of LRRK2 RNA in vitro in at least one single dose assay.

17. Nucleobases 4,062-4,086 of SEQ ID NO: 1

In certain embodiments, nucleobases 4,062-4,086 of SEQ ID NO: 1 comprise a hotspot region. In certain embodiments, siRNAs are complementary to nucleobases 4,062-4,086 of SEQ ID NO: 1. In certain embodiments, modified oligonucleotides are complementary to nucleobases 4,062-4,086 of SEQ ID NO: 1. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 39, 231, 232, 233, 1161, and 1162 are complementary to nucleobases 4,062-4,086 of SEQ ID NO: 1.

In certain embodiments, modified oligonucleotides complementary to nucleobases 4,062-4,086 of SEQ ID NO: 1 achieve at least 56% reduction of LRRK2 RNA in vitro in at least one single dose assay.

Nonlimiting Disclosure and Incorporation by Reference

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "ATmCGAUCG," wherein mC indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1: Effect of 5-10-5 MOE Gapmers with Phosphorothioate Internucleoside Linkages on Human LRRK2 RNA Expression In Vitro, Single Dose Modified oligonucleotides complementary to a human LRRK2 nucleic acid were designed and tested for their effect on LRRK2 RNA in vitro.

Cultured SH-SY5Y cells at a density of 20,000 cells per well were transfected using electroporation with 5,000 nM concentration of modified oligonucleotide or no modified oligonucleotide for untreated controls. After approximately 24 hours, RNA was isolated from the cells and LRRK2 RNA levels were measured by quantitative real-time PCR Human primer probe set RTS3133_MGB (forward sequence TTCCACACTTGCGGTCTTTAGA, designated herein as SEQ ID NO: 11; reverse sequence GCGGGACCTGGTAGGTACTG, designated herein as SEQ ID NO: 12; probe sequence ATGAGCAGCAATGAT, designated herein as SEQ ID: 13) was used to measure RNA levels. LRRK2 RNA levels were adjusted according to total RNA content, as measured by RIBOGREEN®. Results are presented in the table below as percent LRRK2 RNA levels relative to untreated control cells. The modified oligonucleotides with percent control values marked with an asterisk (*) target the amplicon region of the primer probe set. Additional assays may be used to measure the potency and efficacy of oligonucleotides targeting the amplicon region.

The modified oligonucleotides on Table 1 are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides. The sugar motif for the gapmers is (from 5' to 3'): eeeeedddddddddeeeee; wherein 'd' represents a 2'-deoxyribose sugar and 'e' represents a 2'-MOE modified sugar. Each internucleoside linkage is a phosphorothioate internucleoside linkage and each cytosine residue is a 5-methyl cytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Table 1 below is complementary to human LRRK2 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to the sequence of human LRRK2 RNA reduced the amount of human LRRK2 RNA.

TABLE 1

Percent control of human LRRK2 RNA with 5-10-5 MOE gapmers
with phosphorothioate internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence | LRRK2 % control | SEQ ID NO |
|---|---|---|---|---|---|---|---|
| 422420 | 368 | 387 | 10392 | 10411 | ATTAATTTGCACAGAAGTGA | 75 | 30 |
| 422421 | 375 | 394 | 10399 | 10418 | GACTTCTATTAATTTGCACA | 65 | 31 |
| 422425 | 441 | 460 | 10465 | 10484 | ACCAAGGACTTCCCAATCAT | 111 | 32 |
| 422428 | 606 | 625 | 16126 | 16145 | GTGCATGGCATCAAAAATTA | 35 | 33 |
| 422433 | 1791 | 1810 | 52705 | 52724 | TCCACATTTCTGAATCCCAG | 24 | 34 |
| 422435 | 1904 | 1923 | N/A | N/A | TCTTGGTCATCTGGATACAT | 76 | 35 |
| 422436 | 1913 | 1932 | N/A | N/A | CACTGAATTTCTTGGTCATC | 84 | 36 |
| 422437 | 1919 | 1938 | N/A | N/A | CCCAGACACTGAATTTCTTG | 53 | 37 |
| 422450 | 3886 | 3905 | N/A | N/A | GAGGAATCTCTTTCAGTTTA | 58 | 38 |
| 422451 | 4064 | 4083 | 84059 | 84078 | AACCTTATGATGTCTTTGGC | 44 | 39 |
| 422456 | 4472 | 4491 | 88573 | 88592 | GAAACATCCAAATGTGTGCC | 64 | 40 |
| 422457 | 4484 | 4503 | 88585 | 88604 | TGCTTCTCATCAGAAACATC | 66 | 41 |
| 422458 | 4580 | 4599 | 88681 | 88700 | TCCTCGGTGGCATTCACAAA | 96 | 42 |
| 422461 | 4908 | 4927 | 93369 | 93388 | CCACTTGGGTTCCACAAAGT | 39 | 43 |
| 422462 | 4915 | 4934 | 93376 | 93395 | TACAAAGCCACTTGGGTTCC | 57 | 44 |
| 422466 | 5480 | 5499 | 100469 | 100488 | GGAAACCATTCTTCCATGAG | 85 | 45 |
| 422469 | 5702 | 5721 | 101340 | 101359 | TTTCTAGGCAGGTCAGCCAA | 74 | 46 |
| 422470 | 5978 | 5997 | 113175 | 113194 | AGCAGGCGATCCAAGGAACC | 90 | 47 |
| 422472 | 6139 | 6158 | 118472 | 118491 | CAATGATGGCAGCATTGGGA | 72 | 48 |
| 422475 | 6260 | 6279 | 124891 | 124910 | TGTTGGTTATAAATGACATT | 81 | 49 |
| 422477 | 6461 | 6480 | 126577 | 126596 | TGAGGATTTTCTTTCAAACA | 96 | 50 |
| 422479 | 6500 | 6519 | 129645 | 129664 | TTCAAAATGTCAAAGACCTG | 98 | 51 |
| 422480 | 6841 | 6860 | 132551 | 132570 | AAGTGACAGAATCAGTCATC | 83 | 52 |
| 422483 | 7108 | 7127 | 137512 | 137531 | TGAGTTTCTGAATGGTGAAA | 92 | 53 |
| 438386 | 117 | 136 | 3236 | 3255 | GCTGCCACTAGCCATGGTGG | 99 | 54 |
| 438387 | 185 | 204 | 3304 | 3323 | TCCTGGACATTGTTCAGCCT | 48 | 55 |
| 438388 | 381 | 400 | 10405 | 10424 | TGGACAGACTTCTATTAATT | 73 | 56 |
| 438401 | 3944 | 3963 | 83939 | 83958 | AGTTCCAAGTTGTAACTGAC | 71 | 57 |
| 438405 | 4408 | 4427 | 87312 | 87331 | AGAGCCAAGGCTTCATGGCA | 98 | 58 |
| 438408 | 4619 | 4638 | 88720 | 88739 | TTTATGATGGTTTTCCGAAG | 107 | 59 |
| 438410 | 4649 | 4668 | N/A | N/A | TGATCTCGGATCTTGAAATT | 88 | 60 |
| 438429 | 8882 | 8901 | 147051 | 147070 | ATGAATACTGGTCAGGGCCA | 77 | 61 |
| 438432 | N/A | N/A | 4483 | 4502 | AAACTGATTTCAGTTCCCCA | 50 | 62 |
| 438433 | N/A | N/A | 52819 | 52838 | ACCTTGGTCATCTGGATACA | 93 | 63 |
| 438434 | N/A | N/A | 92072 | 92091 | TGATCTCGGATCTATGAAAT | 94 | 64 |
| 438436 | N/A | N/A | 114858 | 114877 | CCCCTGGTGTTCAAAAGCAG | 69 | 65 |

TABLE 1-continued

Percent control of human LRRK2 RNA with 5-10-5 MOE gapmers with phosphorothioate internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence | LRRK2 % control | SEQ ID NO |
|---|---|---|---|---|---|---|---|
| 438437 | N/A | N/A | 129638 | 129657 | TGTCAAAGACCTGAGAAAGT | 116 | 66 |
| 438538 | 171 | 190 | 3290 | 3309 | CAGCCTGACTATCAACTTCT | 35 | 67 |
| 438539 | 436 | 455 | 10460 | 10479 | GGACTTCCCAATCATTTCCA | 90 | 68 |
| 438540 | 1074 | 1093 | N/A | N/A | GAAAATAGTCTCAGTGAGGA | 70 | 69 |
| 438541 | 1078 | 1097 | N/A | N/A | TTAAGAAAATAGTCTCAGTG | 98 | 70 |
| 438542 | 2275 | 2294 | 56283 | 56302 | CCATGATGCTGTTATTCTGA | 54 | 71 |
| 438543 | 2282 | 2301 | 56290 | 56309 | CATTCAACCATGATGCTGTT | 50 | 72 |
| 438544 | 2361 | 2380 | 61982 | 62001 | GCTCTCTTTCTCACATACCT | 22 | 73 |
| 438545 | 2366 | 2385 | 61987 | 62006 | GGACTGCTCTCTTTCTCACA | 26 | 74 |
| 438546 | 2525 | 2544 | 62146 | 62165 | AATCCTCCAAGGCAAATGCT | 55 | 75 |
| 438547 | 2564 | 2583 | 62185 | 62204 | AAAGGACCAAGCCAAGAAGG | 58 | 76 |
| 438548 | 2571 | 2590 | 62192 | 62211 | TGGAAATAAAGGACCAAGCC | 27 | 77 |
| 438549 | 2759 | 2778 | 65597 | 65616 | ACACTGTCCATAGAAGAGTC | 56 | 78 |
| 438550 | 2764 | 2783 | 65602 | 65621 | CAAACACACTGTCCATAGAA | 44 | 79 |
| 438551 | 3503 | 3522 | 77252 | 77271 | AAAATCTTCAGTTCCTTCAG | 82 | 80 |
| 438552 | 3857 | 3876 | 82202 | 82221 | AGATGCAGTTTCTCTACTCT | 67 | 81 |
| 438553 | 4300 | 4319 | N/A | N/A | CCTCACGACCTGCAAAATCC | 65 | 82 |
| 438554 | 4305 | 4324 | N/A | N/A | GAATTCCTCACGACCTGCAA | 77 | 83 |
| 438555 | 4480 | 4499 | 88581 | 88600 | TCTCATCAGAAACATCCAAA | 77 | 84 |
| 438556 | 4575 | 4594 | 88676 | 88695 | GGTGGCATTCACAAAGTGGT | 52 | 85 |
| 438557 | 4641 | 4660 | N/A | N/A | GATCTTGAAATTAAGGCTCT | 69 | 86 |
| 438558 | 5225 | 5244 | 99231 | 99250 | AATCTTGACCAAAATCCCAT | 79 | 87 |
| 438559 | 5530 | 5549 | 100519 | 100538 | TCTTCAACAGAGTTTCTCCT | 81 | 88 |
| 438560 | 5537 | 5556 | 100526 | 100545 | GCCCATTTCTTCAACAGAGT | 30 | 89 |
| 438561 | 5568 | 5587 | 100557 | 100576 | ATGTTCTTCACCATCATTAA | 98 | 90 |
| 438562 | 5735 | 5754 | 101373 | 101392 | TCAAATTCCAACTCATCATT | 111 | 91 |
| 438563 | 5825 | 5844 | 106516 | 106535 | AAAATCTTCACAGCCACTTC | 109 | 92 |
| 438564 | 5829 | 5848 | 106520 | 106539 | ATTAAAAATCTTCACAGCCA | 136 | 93 |
| 438565 | 6000 | 6019 | 113197 | 113216 | GAGGCTGGCTTTGTCCTGCT | 52 | 94 |
| 438566 | 6074 | 6093 | 118407 | 118426 | ATAATCATGGCTGAGTGGAG | 83 | 95 |
| 438567 | 6135 | 6154 | 118468 | 118487 | GATGGCAGCATTGGGATACA | 90 | 96 |
| 438568 | 6401 | 6420 | 126517 | 126536 | CCATATTCTTTAACTGGATC | 74 | 97 |
| 438569 | 6427 | 6446 | 126543 | 126562 | TCTCAACCATAGGCCATGGG | 47 | 98 |
| 438570 | 6465 | 6484 | 126581 | 126600 | TTCTTGAGGATTTTCTTTCA | 106 | 99 |
| 438571 | 6494 | 6513 | N/A | N/A | ATGTCAAAGACCTGGGCAGA | 107 | 100 |

TABLE 1-continued

Percent control of human LRRK2 RNA with 5-10-5 MOE gapmers with phosphorothioate internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence | LRRK2 % control | SEQ ID NO |
|---|---|---|---|---|---|---|---|
| 438572 | 6572 | 6591 | 129717 | 129736 | GCAACCATGCATTCAACAAT | 76 | 101 |
| 438573 | 6696 | 6715 | 132406 | 132425 | TCTACTATCAGCAACTTCCT | 89 | 102 |
| 438574 | 6845 | 6864 | 132555 | 132574 | AAACAAGTGACAGAATCAGT | 110 | 103 |
| 438575 | 7632 | 7651 | 145801 | 145820 | GTGTTTTTCTAAATTTTGCA | 65 | 104 |
| 438576 | 7640 | 7659 | 145809 | 145828 | ACTTCAATGTGTTTTTCTAA | 105 | 105 |
| 438577 | N/A | N/A | 3658 | 3677 | AAATAACTTGGAGGCTGGAA | 114 | 106 |
| 438578 | N/A | N/A | 4487 | 4506 | GACAAAACTGATTTCAGTTC | 82 | 107 |
| 438579 | N/A | N/A | 77354 | 77373 | CACTTACCAAGAAAATTCAT | 118 | 108 |
| 438580 | N/A | N/A | 116733 | 116752 | ATTATAGAATTTAATCTTAA | 96 | 109 |
| 438581 | N/A | N/A | 142937 | 142956 | ACCTCCCTAGAACCATAAAG | 104 | 110 |
| 438582 | 60 | 79 | 3179 | 3198 | TCCGCTGCTCAGGGAACCGG | 65 | 111 |
| 438583 | 449 | 468 | 10473 | 10492 | TGGTGAACACCAAGGACTTC | 55 | 112 |
| 438584 | 457 | 476 | N/A | N/A | GAATCAATTGGTGAACACCA | 63 | 113 |
| 438585 | 529 | 548 | 13795 | 13814 | GGAGGAGATCTAAGGTCTTC | 90 | 114 |
| 438586 | 550 | 569 | N/A | N/A | AGGTGATTTTACCTGAAGTT | 64 | 115 |
| 438587 | 624 | 643 | 16144 | 16163 | ATCATTGGCTGGAAATGAGT | 51 | 116 |
| 438588 | 883 | 902 | 21714 | 21733 | GGAATGCTTTCATAGCTTCC | 56 | 117 |
| 438589 | 1166 | 1185 | 29427 | 29446 | TTGTAACAGGCTTCCAGCCA | 53 | 118 |
| 438590 | 1300 | 1319 | N/A | N/A | CCCTATGAGCTGGGAAATGG | 79 | 119 |
| 438591 | 1534 | 1553 | N/A | N/A | CCAGGGAAGTGTTGCTTCCT | 77 | 120 |
| 438592 | 1610 | 1629 | 37659 | 37678 | TCCAGCTGCACTGGTAATGA | 90 | 121 |
| 438593 | 1774 | 1793 | N/A | N/A | CAGGATTTCCAATGAACCTG | 72 | 122 |
| 438594 | 1885 | 1904 | 52799 | 52818 | TCTGCAGTGTGTGAAGCACT | 76 | 123 |
| 438595 | 2108 | 2127 | 56042 | 56061 | TGATGCACCAGCAGCTTAGA | 48 | 124 |
| 438596 | 2318 | 2337 | 56326 | 56345 | TTTGCTTGATTGGCATCTGC | 55 | 125 |
| 438597 | 2380 | 2399 | 62001 | 62020 | GTTCCACCAATTTGGGACTG | 34 | 126 |
| 438598 | 2412 | 2431 | 62033 | 62052 | ATCTTGTTCACGAGATCCAC | 70 | 127 |
| 438599 | 2515 | 2534 | 62136 | 62155 | GGCAAATGCTATTGTTGGCC | 63 | 128 |
| 438600 | 3171 | 3190 | 73707 | 73726 | GAGTGCATTCTGGTGAAGCT | 70 | 129 |
| 438601 | 3211 | 3230 | N/A | N/A | AACTCTTCAGAGTTTCACAT | 94 | 130 |
| 438602 | 3475 | 3494 | 77224 | 77243 | GGGAGCATATCCCTGATATT | 42 | 131 |
| 438603 | 3565 | 3584 | 77314 | 77333 | CTTTAGGACAAGCCTCAAGA | 71 | 132 |
| 438604 | 3702 | 3721 | N/A | N/A | AGACCGCAAGTGTGGAAGAT | 17* | 133 |
| 438605 | 3707 | 3726 | N/A | N/A | TCTAAAGACCGCAAGTGTGG | 22* | 134 |
| 438606 | 3930 | 3949 | 83925 | 83944 | ACTGACATCCAGAGATGTCA | 126 | 135 |
| 438607 | 3952 | 3971 | 83947 | 83966 | AGGATCTTAGTTCCAAGTTG | 95 | 136 |

TABLE 1-continued

Percent control of human LRRK2 RNA with 5-10-5 MOE gapmers
with phosphorothioate internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence | LRRK2 % control | SEQ ID NO |
|---|---|---|---|---|---|---|---|
| 438608 | 3957 | 3976 | 83952 | 83971 | GGGAAAGGATCTTAGTTCCA | 70 | 137 |
| 438609 | 3969 | 3988 | 83964 | 83983 | CCCCATTTCATTGGGAAAGG | 77 | 138 |
| 438610 | 4190 | 4209 | 86685 | 86704 | CCAAGATCTGATTTCTTGGT | 104 | 139 |
| 438611 | 4353 | 4372 | 87257 | 87276 | AGCAAGGTACAATGCTCGCT | 69 | 140 |
| 438612 | 4395 | 4414 | 87299 | 87318 | CATGGCATCAACTTCAGCCT | 83 | 141 |
| 438613 | 4413 | 4432 | 87317 | 87336 | ATTGAAGAGCCAAGGCTTCA | 94 | 142 |
| 438614 | 4422 | 4441 | N/A | N/A | AGCCTTTATATTGAAGAGCC | 103 | 143 |
| 438615 | 4428 | 4447 | N/A | N/A | AGCGCGAGCCTTTATATTGA | 91 | 144 |
| 438616 | 4433 | 4452 | N/A | N/A | GAAGAAGCGCGAGCCTTTAT | 66 | 145 |
| 438617 | 4544 | 4563 | 88645 | 88664 | GCAGGGAACCCTCGCTTATT | 97 | 146 |
| 438618 | 4682 | 4701 | 92105 | 92124 | TAGCAGTCTGGAATCAGCTG | 89 | 147 |
| 438619 | 4816 | 4835 | 92239 | 92258 | CGTGAGGAAGCTCATTTTCA | 70 | 148 |
| 438620 | 4963 | 4982 | 98111 | 98130 | GTTTTGGACAACCTTCCACT | 96 | 149 |
| 438621 | 5074 | 5093 | 98222 | 98241 | TCTGGAATTTTTCTAGGAGC | 62 | 150 |
| 438622 | 5116 | 5135 | 98264 | 98283 | TGCTTGGAACCAGCAAATAT | 78 | 151 |
| 438623 | 5451 | 5470 | 100440 | 100459 | GTGGTCCACAACTTGGCCCA | 71 | 152 |
| 438624 | 5745 | 5764 | 101383 | 101402 | TGGAGCTTGTTCAAATTCCA | 104 | 153 |
| 438625 | 5887 | 5906 | 113084 | 113103 | GGTGGAGGTGGCAAAGCACC | 78 | 154 |
| 438626 | 5968 | 5987 | 113165 | 113184 | CCAAGGAACCCTTGGAGGCT | 97 | 155 |
| 438627 | 5986 | 6005 | 113183 | 113202 | CCTGCTGAAGCAGGCGATCC | 75 | 156 |
| 438628 | 5991 | 6010 | 113188 | 113207 | TTTGTCCTGCTGAAGCAGGC | 89 | 157 |
| 438629 | 6058 | 6077 | N/A | N/A | GGAGGTATCTCAAACCATCA | 111 | 158 |
| 438630 | 6149 | 6168 | 118482 | 118501 | GCAATCTTTGCAATGATGGC | 72 | 159 |
| 438631 | 6157 | 6176 | 118490 | 118509 | CGTAGTCAGCAATCTTTGCA | 78 | 160 |
| 438632 | 6581 | 6600 | 129726 | 129745 | TGATGTGTAGCAACCATGCA | 62 | 161 |
| 438633 | 6586 | 6605 | 129731 | 129750 | TGTTGTGATGTGTAGCAACC | 77 | 162 |
| 438634 | 6613 | 6632 | 129758 | 129777 | AGCCCAGCCAAATGCTTGCA | 97 | 163 |
| 438635 | 6624 | 6643 | 129769 | 129788 | GGTGTGCCCACAGCCCAGCC | 70 | 164 |
| 438636 | 6677 | 6696 | 129822 | 129841 | TCAGAAGTGTATCCTTCAGT | 95 | 165 |
| 438637 | 7373 | 7392 | 143021 | 143040 | GCAGTGTTCTTCTGAAGGCA | 100 | 166 |
| 438638 | 7482 | 7501 | 143130 | 143149 | TGTCATCATGACTCTGACCG | 74 | 167 |
| 438639 | 8333 | 8352 | 146502 | 146521 | AGGACTTTGACAGTATGTCA | 66 | 168 |
| 438640 | 8696 | 8715 | 146865 | 146884 | TCCTTCAGCAACTGAAAAGT | 85 | 169 |
| 438641 | 8748 | 8767 | 146917 | 146936 | TGGAAGCCTAGGGTGGCAGA | 62 | 170 |
| 438642 | 8914 | 8933 | 147083 | 147102 | AGTTGTCCTATCACAGGGAA | 90 | 171 |

TABLE 1-continued

Percent control of human LRRK2 RNA with 5-10-5 MOE gapmers with phosphorothioate internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence | LRRK2 % control | SEQ ID NO |
|---|---|---|---|---|---|---|---|
| 438643 | N/A | N/A | 78939 | 78958 | ATCAGATTCCCCTGAGGTAC | 93 | 172 |
| 438644 | N/A | N/A | 78947 | 78966 | CAGTCTGAATCAGATTCCCC | 85 | 173 |
| 438645 | N/A | N/A | 143365 | 143384 | GTTCAGCTGCAGTAATCTGC | 67 | 174 |
| 438646 | N/A | N/A | 143372 | 143391 | ACTGAGTGTTCAGCTGCAGT | 80 | 175 |
| 438647 | N/A | N/A | 143377 | 143396 | CCCAAACTGAGTGTTCAGCT | 99 | 176 |
| 438648 | N/A | N/A | 10479 | 10498 | ACTTACTGGTGAACACCAAG | 121 | 177 |
| 438649 | N/A | N/A | 31012 | 31031 | ATGAGCTGGGAAACTTTCAA | 84 | 178 |
| 438650 | N/A | N/A | 41888 | 41907 | TCTGGCATGCCTAAATGCAC | 101 | 179 |
| 438651 | N/A | N/A | 52827 | 52846 | TTGTACTGACCTTGGTCATC | 126 | 180 |
| 438652 | N/A | N/A | 76342 | 76361 | TCTTCAGAGTCTGAAAAGAC | 83 | 181 |
| 438653 | N/A | N/A | 88530 | 88549 | AAGCGCGAGCCTGGAGGGAA | 89 | 182 |
| 438654 | N/A | N/A | 118392 | 118411 | TGGAGGTATCTGCCAGAAAA | 91 | 183 |
| 438655 | N/A | N/A | 118553 | 118572 | ATCACCTACCTGGTGTGCCC | 122 | 184 |

Example 2: Effect of 5-10-5 MOE Gapmers with Mixed Internucleoside Linkages on Human LRRK2 RNA Expression In Vitro, Single Dose Modified oligonucleotides complementary to a human LRRK2 nucleic acid were designed and tested for their effect on LRRK2 RNA in vitro. The modified oligonucleotides were tested in a series of experiments that had similar culture conditions.

Cultured SH-SY5Y cells at a density of 20,000 cells per well were transfected using electroporation with 5,000 nM concentration of modified oligonucleotide or no modified oligonucleotide for untreated controls. After approximately 24 hours, RNA was isolated from the cells and LRRK2 RNA levels were measured by quantitative real-time PCR Human primer probe sets RTS3132 (forward sequence CAT-CACTCAGGCTGTTAAGACAAGA, designated herein as SEQ ID NO: 14; reverse sequence CAGCTGCCAGCAAA-GATATCAA, designated herein as SEQ ID NO: 15; probe sequence CTTTGCCACCTCCACCACCCCA, designated herein as SEQ ID: 16), RTS3133_MGB (forward sequence TTCCACACTTGCGGTCTTTAGA, designated herein as SEQ ID NO: 11; reverse sequence GCGGGACCTGGTAGGTACTG, designated herein as SEQ ID NO: 12; probe sequence ATGAGCAGCAATGAT, designated herein as SEQ ID: 13), and RTS3146_MGB (forward sequence GAGCTTCCTCACGCAGTTCAC, designated herein as SEQ ID NO: 17; reverse sequence TGCTGGGTCTTGAAAATGAAGA, designated herein as SEQ ID NO: 18; probe sequence TTCTAAATGAATCAG-GAGTCC, designated herein as SEQ ID: 19) were used to measure RNA levels. LRRK2 RNA levels were adjusted according to total RNA content, as measured by RIBOGREEN®. Results are presented in the table below as percent LRRK2 RNA levels relative to untreated control cells. The modified oligonucleotides with percent control values marked with an asterisk (*) target the amplicon region of the primer probe set.

The modified oligonucleotides in Table 2 are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides. The sugar motif for the gapmers is (from 5' to 3'): eeeeedddddddddd-deeeee; wherein 'd' represents a 2'-deoxyribose sugar and 'e' represents a 2'-MOE modified sugar. All cytosine residues throughout each gapmer are 5-methyl cytosines. The internucleoside linkages for each gapmer are mixed phosphodiester and phosphorothioate linkages. The internucleoside linkage motif for the gapmers is (from 5' to 3'): sooosssssssssssooss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Table 2 below is complementary to human LRRK2 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to the sequence of human LRRK2 RNA reduced the amount of human LRRK2 RNA.

TABLE 2

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control RTS3132 | LRRK2 % control RTS3133_MGB | LRRK2 % control RTS3146_MGB | SEQ ID NO |
|---|---|---|---|---|---|---|---|---|---|
| 693423 | 4064 | 4083 | 84059 | 84078 | AACCTTATGATGTCTTTGGC | 15 | 31 | 18 | 39 |
| 693424 | 4908 | 4927 | 93369 | 93388 | CCACTTGGGTTCCACAAAGT | 24 | 31 | 24 | 43 |
| 693428 | 2361 | 2380 | 61982 | 62001 | GCTCTCTTTCTCACATACCT | 10 | 14 | 11 | 73 |
| 693429 | 2571 | 2590 | 62192 | 62211 | TGGAAATAAAGGACCAAGCC | 26 | 31 | 27 | 77 |
| 780202 | 2368 | 2387 | 61989 | 62008 | TGGGACTGCTCTCTTTCTCA | 19 | 26 | 20 | 185 |
| 780203 | 2371 | 2390 | 61992 | 62011 | ATTTGGGACTGCTCTCTTTC | 28 | 36 | 32 | 186 |
| 780204 | 2406 | 2425 | 62027 | 62046 | TTCACGAGATCCACTATTCA | 48 | 51 | 51 | 187 |
| 780205 | 2451 | 2470 | 62072 | 62091 | GTCACCTTTCCCAATGCTTA | 21 | 35 | 29 | 188 |
| 780206 | 2499 | 2518 | 62120 | 62139 | GGCCACATCCAGGGCCAGCC | 56 | 62 | 45 | 189 |
| 780207 | 2543 | 2562 | 62164 | 62183 | TCAACTTTTCCTATACAAAA | 38 | 42 | 47 | 190 |
| 780208 | 2566 | 2585 | 62187 | 62206 | ATAAAGGACCAAGCCAAGAA | 53 | 56 | 64 | 191 |
| 780209 | 2569 | 2588 | 62190 | 62209 | GAAATAAAGGACCAAGCCAA | 48 | 53 | 54 | 192 |
| 780210 | 2573 | 2592 | 62194 | 62213 | TCTGGAAATAAAGGACCAAG | 21 | 24 | 27 | 193 |
| 780211 | 2576 | 2595 | 62197 | 62216 | TTATCTGGAAATAAAGGACC | 39 | 37 | 41 | 194 |
| 780212 | 2587 | 2606 | 62208 | 62227 | AATTAGAAGTCTTATCTGGA | 59 | 61 | 59 | 195 |
| 780213 | 2632 | 2651 | 65470 | 65489 | TCACCATTCTTGCTAGTGTA | 41 | 42 | 50 | 196 |
| 780214 | 2678 | 2697 | 65516 | 65535 | CCTGAGGCTGTTCCTTCTTC | 37 | 47 | 44 | 197 |
| 780215 | 2722 | 2741 | 65560 | 65579 | CATCAAATTTAGACAGCACA | 41 | 44 | 48 | 198 |
| 780216 | 2759 | 2778 | 65597 | 65616 | ACACTGTCCATAGAAGAGTC | 50 | 48 | 45 | 78 |
| 780217 | 2762 | 2781 | 65600 | 65619 | AACACACTGTCCATAGAAGA | 41 | 47 | 43 | 199 |
| 780218 | 2764 | 2783 | 65602 | 65621 | CAAACACACTGTCCATAGAA | 31 | 39 | 37 | 79 |
| 780219 | 2766 | 2785 | 65604 | 65623 | AGCAAACACACTGTCCATAG | 21 | 27 | 24 | 200 |
| 780220 | 2769 | 2788 | 65607 | 65626 | TTGAGCAAACACACTGTCCA | 34 | 37 | 36 | 201 |
| 780221 | 2810 | 2829 | 71653 | 71672 | AGAAATGAGCCTTCACTTCC | 35 | 49 | 41 | 202 |
| 780222 | 2854 | 2873 | 71697 | 71716 | GGTAAAATTCTCCTACACTA | 37 | 39 | 38 | 203 |
| 780223 | 2898 | 2917 | 71741 | 71760 | ATGTCTTTGCAAATTTGGTG | 41 | 46 | 38 | 204 |
| 780224 | 2942 | 2961 | 72966 | 72985 | TTCAGTAAATCTTCATGATC | 55 | 57 | 64 | 205 |
| 780225 | 2986 | 3005 | N/A | N/A | ATGACCTGAGTGAATCATCT | 51 | 46 | 55 | 206 |
| 780226 | 3031 | 3050 | 73567 | 73586 | GAGAAGAAATGCTGTCTGAA | 54 | 61 | 62 | 207 |
| 780227 | 3075 | 3094 | 73611 | 73630 | TGCTGAAAGGTCTAGTGATG | 34 | 37 | 37 | 208 |
| 780228 | 3120 | 3139 | 73656 | 73675 | TATACAGCATTTCTGGCTTA | 61 | 79 | 59 | 209 |
| 780229 | 3164 | 3183 | 73700 | 73719 | TTCTGGTGAAGCTCCAGCTT | 27 | 32 | 29 | 210 |
| 780230 | 3208 | 3227 | N/A | N/A | TCTTCAGAGTTTCACATAGC | 62 | 70 | 61 | 211 |
| 780231 | 3256 | 3275 | 76390 | 76409 | AAGGAAATGATGTAAATTTA | 65 | 70 | 69 | 212 |
| 780232 | 3300 | 3319 | 76434 | 76453 | AGAGACATCAAGATTAGCAA | 24 | 33 | 35 | 213 |
| 780233 | 3344 | 3363 | 76478 | 76497 | TTCACTGTAGGATCTAAAAC | 46 | 45 | 45 | 214 |

TABLE 2-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control RTS3132 | LRRK2 % control RTS3133_MGB | LRRK2 % control RTS3146_MGB | SEQ ID NO |
|---|---|---|---|---|---|---|---|---|---|
| 780234 | 3389 | 3408 | 76523 | 76542 | GACAGCTGGTTATATGACAG | 30 | 31 | 29 | 215 |
| 780235 | 3433 | 3452 | 76567 | 76586 | GCTCCAGTTTCTCTACCACA | 41 | 40 | 50 | 216 |
| 780236 | 3494 | 3513 | 77243 | 77262 | AGTTCCTTCAGTCTCAAGGG | 16 | 31 | 22 | 217 |
| 780237 | 3538 | 3557 | 77287 | 77306 | CTGATAGGGATGAAATGTGG | 27 | 31 | 28 | 218 |
| 780238 | 3582 | 3601 | 77331 | 77350 | GGCACTGAAACTCTCCACTT | 25 | 37 | 27 | 219 |
| 780239 | 3626 | 3645 | 80906 | 80925 | ATAGAAGGAGGCAAGAAAGG | 47 | 60 | 67 | 220 |
| 780240 | 3670 | 3689 | 80950 | 80969 | CTGGAATACAGGAAAATTTG | 52 | 44 | 51 | 221 |
| 780241 | 3714 | 3733 | 82059 | 82078 | GCTCATATCTAAAGACCGCA | 10 | 3* | 13 | 222 |
| 780242 | 3758 | 3777 | 82103 | 82122 | GATTTCCAGTGTGCGGGACC | 27 | 20* | 33 | 223 |
| 780243 | 3802 | 3821 | 82147 | 82166 | TGCTGATCTGATTATGGCTA | 22 | 36 | 33 | 224 |
| 780244 | 3846 | 3865 | 82191 | 82210 | CTCTACTCTAGACCATAAAT | 25 | 32 | 28 | 225 |
| 780245 | 3891 | 3910 | N/A | N/A | CTCAGGAGGAATCTCTTTCA | 43 | 47 | 51 | 226 |
| 780246 | 3935 | 3954 | 83930 | 83949 | TTGTAACTGACATCCAGAGA | 63 | 75 | 74 | 227 |
| 780247 | 3979 | 3998 | 83974 | 83993 | TGCTTAATTTCCCCATTTCA | 23 | 41 | 37 | 228 |
| 780248 | 4023 | 4042 | 84018 | 84037 | ATCAAAGTTAAGATGCAGTT | 25 | 30 | 29 | 229 |
| 780249 | 4059 | 4078 | 84054 | 84073 | TATGATGTCTTTGGCTTTAC | 33 | 41 | 36 | 230 |
| 780250 | 4062 | 4081 | 84057 | 84076 | CCTTATGATGTCTTTGGCTT | 28 | 34 | 31 | 231 |
| 780251 | 4066 | 4085 | N/A | N/A | GAAACCTTATGATGTCTTTG | 42 | 39 | 41 | 232 |
| 780252 | 4067 | 4086 | N/A | N/A | AGAAACCTTATGATGTCTTT | 34 | 45 | 50 | 233 |
| 780253 | 4069 | 4088 | N/A | N/A | GAAGAAACCTTATGATGTCT | 44 | 61 | 47 | 234 |
| 780254 | 4111 | 4130 | 86606 | 86625 | GTTTCATTCGGTTATAAGGC | 17 | 24 | 14 | 235 |
| 780255 | 4155 | 4174 | 86650 | 86669 | CAATAAGGTGGTTTTACCAC | 35 | 51 | 47 | 236 |
| 780256 | 4199 | 4218 | 86694 | 86713 | CTTTGCATTCCAAGATCTGA | 30 | 33 | 32 | 237 |
| 780257 | 4243 | 4262 | 86738 | 86757 | TTATTTGGATAGGCCAGTCT | 34 | 42 | 50 | 238 |
| 780258 | 4287 | 4306 | 86782 | 86801 | AAAATCCCACACATTTAGGA | 54 | 60 | 57 | 239 |
| 780259 | 4350 | 4369 | 87254 | 87273 | AAGGTACAATGCTCGCTGCG | 51 | 65 | 51 | 240 |
| 780260 | 4394 | 4413 | 87298 | 87317 | ATGGCATCAACTTCAGCCTG | 45 | 41 | 49 | 241 |
| 780261 | 4438 | 4457 | 88539 | 88558 | GGGAAGAAGAAGCGCGAGCC | 29 | 41 | 32 | 242 |
| 780262 | 4483 | 4502 | 88584 | 88603 | GCTTCTCATCAGAAACATCC | 30 | 41 | 35 | 243 |
| 780263 | 4527 | 4546 | 88628 | 88647 | ATTCAGGAGTTCCTTGGTGA | 43 | 85 | 47 | 244 |
| 780264 | 4571 | 4590 | 88672 | 88691 | GCATTCACAAAGTGGTAATC | 35 | 43 | 35 | 245 |
| 780265 | 4615 | 4634 | 88716 | 88735 | TGATGGTTTTCCGAAGTTTT | 43 | 46 | 49 | 246 |
| 780266 | 4659 | 4678 | 92082 | 92101 | AACAACAAGCTGATCTCGGA | 49 | 57 | 56 | 247 |
| 780267 | 4703 | 4722 | 92126 | 92145 | ATGATTTTTTCAAGTTCTAC | 31 | 47 | 45 | 248 |
| 780268 | 4747 | 4766 | 92170 | 92189 | CAATTACGGGAAATTCAATT | 68 | 60 | 57 | 249 |

TABLE 2-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control RTS3132 | LRRK2 % control RTS3133_MGB | LRRK2 % control RTS3146_MGB | SEQ ID NO |
|---|---|---|---|---|---|---|---|---|---|
| 780269 | 4791 | 4810 | 92214 | 92233 | CTGCAGCTGATTTTCTCTCA | 23 | 32 | 27 | 250 |
| 780270 | 4835 | 4854 | 92258 | 92277 | TCATTTAGAAAGTGAACTGC | 40 | 51 | 54* | 251 |
| 780271 | 4883 | 4902 | 93344 | 93363 | TCACTTAACTGCAGTGCTGG | 27 | 38 | 10* | 252 |
| 780272 | 4903 | 4922 | 93364 | 93383 | TGGGTTCCACAAAGTACAAG | 41 | 47 | 42 | 253 |
| 780273 | 4906 | 4925 | 93367 | 93386 | ACTTGGGTTCCACAAAGTAC | 42 | 38 | 38 | 254 |
| 780274 | 4910 | 4929 | 93371 | 93390 | AGCCACTTGGGTTCCACAAA | 28 | 43 | 30 | 255 |
| 780275 | 4913 | 4932 | 93374 | 93393 | CAAAGCCACTTGGGTTCCAC | 31 | 43 | 38 | 256 |

Example 3: Effect of 5-10-5 MOE Gapmers with Mixed Internucleoside Linkages on Human LRRK2 RNA Expression In Vitro, Single Dose Modified oligonucleotides complementary to a human LRRK2 nucleic acid were designed and tested for their effect on LRRK2 RNA in vitro. The modified oligonucleotides were tested in a series of experiments that had similar culture conditions.

Cultured SH-SY5Y cells at a density of 20,000 cells per well were transfected using electroporation with 3,000 nM concentration of modified oligonucleotide or no modified oligonucleotide for untreated controls. After approximately 24 hours, RNA was isolated from the cells and LRRK2 RNA levels were measured by quantitative real-time PCR using human primer probe set RTS3132 as described in Example 2. LRRK2 RNA levels were adjusted according to total RNA content, as measured by RIBOGREEN®. Results are presented in the table below as percent LRRK2 RNA levels relative to untreated control cells. The modified oligonucleotides with percent control values marked with an asterisk (*) target the amplicon region of the primer probe set. Additional assays may be used to measure the potency and efficacy of oligonucleotides targeting the amplicon region.

The modified oligonucleotides in Tables 3-9 are 5-10-5 MOE gapmers. The gapmers are 20 nucleobases in length, wherein the central gap segment comprises ten 2'-deoxy-nucleosides and is flanked by wing segments on both the 5' end and on the 3' end comprising five 2'-MOE nucleosides. The sugar motif for the gapmers is (from 5' to 3'): eeeeedddddddddddeeeee; wherein 'd' represents a 2'-deoxyribose sugar and 'e' represents a 2'-MOE modified sugar. All cytosine residues throughout each gapmer are 5-methyl cytosines. The internucleoside linkages for each gapmer are mixed phosphodiester and phosphorothioate linkages. The internucleoside linkage motif for the gapmers is (from 5' to 3'): sooosssssssssssooss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Tables 3-9 below is complementary to human LRRK2 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to the sequence of human LRRK2 RNA reduced the amount of human LRRK2 RNA.

TABLE 3

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 690092 | 171 | 190 | 3290 | 3309 | CAGCCTGACTATCAACTTCT | 57 | 67 |
| 690093 | 2366 | 2385 | 61987 | 62006 | GGACTGCTCTCTTTCTCACA | 70 | 74 |
| 693420 | 606 | 625 | 16126 | 16145 | GTGCATGGCATCAAAAATTA | 41 | 33 |
| 693421 | 1791 | 1810 | 52705 | 52724 | TCCACATTTCTGAATCCCAG | 48 | 34 |
| 693428 | 2361 | 2380 | 61982 | 62001 | GCTCTCTTTCTCACATACCT | 51 | 73 |
| 693438 | 883 | 902 | 21714 | 21733 | GGAATGCTTTCATAGCTTCC | 43 | 117 |

TABLE 3-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 725607 | 2362 | 2381 | 61983 | 62002 | TGCTCTCTTTCTCACATACC | 35 | 257 |
| 725608 | 2363 | 2382 | 61984 | 62003 | CTGCTCTCTTTCTCACATAC | 40 | 258 |
| 725609 | 2364 | 2383 | 61985 | 62004 | ACTGCTCTCTTTCTCACATA | 62 | 259 |
| 780133 | 1 | 20 | 3120 | 3139 | TCACCGCCCGCAGCCAGCGC | 95 | 260 |
| 780134 | 56 | 75 | 3175 | 3194 | CTGCTCAGGGAACCGGCAGG | 134 | 261 |
| 780135 | 100 | 119 | 3219 | 3238 | TGGCACCTGCTTCCAACCCG | 115 | 262 |
| 780136 | 157 | 176 | 3276 | 3295 | ACTTCTTCAGAGTTTCCTCG | 59 | 263 |
| 780137 | 166 | 185 | 3285 | 3304 | TGACTATCAACTTCTTCAGA | 86 | 264 |
| 780138 | 169 | 188 | 3288 | 3307 | GCCTGACTATCAACTTCTTC | 59 | 265 |
| 780139 | 173 | 192 | 3292 | 3311 | TTCAGCCTGACTATCAACTT | 70 | 266 |
| 780140 | 176 | 195 | 3295 | 3314 | TTGTTCAGCCTGACTATCAA | 87 | 267 |
| 780141 | 203 | 222 | 3322 | 3341 | GTTTCTATCTGTTTTCCTTC | 44 | 268 |
| 780142 | 271 | 290 | N/A | N/A | CTTGAAATAACTTGGAGGCG | 72 | 269 |
| 780143 | 315 | 334 | 3706 | 3725 | ATAGGAGTCCAAGACGATCA | 49 | 270 |
| 780144 | 362 | 381 | 10386 | 10405 | TTGCACAGAAGTGACCAACC | 64 | 271 |
| 780145 | 406 | 425 | 10430 | 10449 | GTCCCATTAAGCTTTGCATT | 48 | 272 |
| 780146 | 451 | 470 | N/A | N/A | ATTGGTGAACACCAAGGACT | 48 | 273 |
| 780147 | 495 | 514 | 13761 | 13780 | CAAGTTTACACTGGCATTAT | 57 | 274 |
| 780148 | 539 | 558 | 13805 | 13824 | CCTGAAGTTAGGAGGAGATC | 32 | 275 |
| 780149 | 585 | 604 | 16105 | 16124 | CATGAAAATATCACTTTCTT | 76 | 276 |
| 780150 | 601 | 620 | 16121 | 16140 | TGGCATCAAAAATTAACATG | 70 | 277 |
| 780151 | 604 | 623 | 16124 | 16143 | GCATGGCATCAAAAATTAAC | 96 | 278 |
| 780152 | 608 | 627 | 16128 | 16147 | GAGTGCATGGCATCAAAAAT | 44 | 279 |
| 780153 | 611 | 630 | 16131 | 16150 | AATGAGTGCATGGCATCAAA | 74 | 280 |
| 780154 | 629 | 648 | 16149 | 16168 | ACTTCATCATTGGCTGGAAA | 57 | 281 |
| 780155 | 673 | 692 | 16193 | 16212 | CTCTCTCAAACAGCACATGT | 74 | 282 |
| 780156 | 717 | 736 | 18616 | 18635 | ATAATCTTTGTTCTCAACAA | 62 | 283 |
| 780157 | 764 | 783 | 18663 | 18682 | ATTTCCTCTTCATCTTTAAA | 134 | 284 |
| 780158 | 808 | 827 | 18707 | 18726 | AAGGAATCGCTAGGGAATGT | 57 | 285 |
| 780159 | 852 | 871 | 21683 | 21702 | ATAACACCTGACATTGCCAC | 48 | 286 |
| 780160 | 878 | 897 | 21709 | 21728 | GCTTTCATAGCTTCCACCAC | 60 | 287 |
| 780161 | 881 | 900 | 21712 | 21731 | AATGCTTTCATAGCTTCCAC | 59 | 288 |
| 780162 | 885 | 904 | 21716 | 21735 | AGGGAATGCTTTCATAGCTT | 34 | 289 |
| 780163 | 888 | 907 | 21719 | 21738 | CATAGGGAATGCTTTCATAG | 99 | 290 |
| 780164 | 896 | 915 | 21727 | 21746 | CTTTCACTCATAGGGAATGC | 34 | 291 |

TABLE 3-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780165 | 940 | 959 | 21771 | 21790 | CTAATGTAAGCCTATGGAGC | 51 | 292 |
| 780166 | 988 | 1007 | 27963 | 27982 | CCACAAACTCATGGACTTCG | 30 | 293 |
| 780167 | 1032 | 1051 | 28007 | 28026 | GATCTGCAATGCTGCATTCT | 58 | 294 |
| 780168 | 1078 | 1097 | N/A | N/A | TTAAGAAATAGTCTCAGTG | 160 | 70 |
| 780169 | 1123 | 1142 | 29384 | 29403 | CATCATCATTCTCTTGATTC | 63 | 295 |
| 780170 | 1167 | 1186 | 29428 | 29447 | TTTGTAACAGGCTTCCAGCC | 46 | 296 |
| 780171 | 1216 | 1235 | N/A | N/A | AGCATGCGGCCTCCTGCACG | 73 | 297 |
| 780172 | 1260 | 1279 | 29611 | 29630 | CTCATGTAAACTGTTTTGGT | 62 | 298 |
| 780173 | 1304 | 1323 | 31020 | 31039 | ACTTCCCTATGAGCTGGGAA | 134 | 299 |
| 780174 | 1348 | 1367 | 31064 | 31083 | GGAAAACTTCCTTTGATGAA | 91 | 300 |
| 780175 | 1417 | 1436 | 35364 | 35383 | TTGATAACAGTATTTTTCTG | 75 | 301 |
| 780176 | 1461 | 1480 | 35408 | 35427 | TATATGCTTCTGCATTAACT | 78 | 302 |
| 780177 | 1505 | 1524 | 35452 | 35471 | TGATTTAGCATTTTACAGCC | 106 | 303 |
| 780178 | 1549 | 1568 | 37598 | 37617 | CTGCTGCCATTATATCCAGG | 56 | 304 |
| 780179 | 1598 | 1617 | 37647 | 37666 | GGTAATGATGTCTCATGACG | 60 | 305 |
| 780180 | 1645 | 1664 | 37694 | 37713 | CAGGCACTATAAAATGTAAA | 93 | 306 |
| 780181 | 1689 | 1708 | 41922 | 41941 | CTTATGATGAAATTCTGTAT | 60 | 307 |
| 780182 | 1734 | 1753 | 41967 | 41986 | TTTGTGAATATCATTCTTGA | 52 | 308 |
| 780183 | 1779 | 1798 | 52693 | 52712 | AATCCCAGGATTTCCAATGA | 78 | 309 |
| 780184 | 1786 | 1805 | 52700 | 52719 | ATTTCTGAATCCCAGGATTT | 119 | 310 |
| 780185 | 1789 | 1808 | 52703 | 52722 | CACATTTCTGAATCCCAGGA | 41 | 311 |
| 780186 | 1793 | 1812 | 52707 | 52726 | AATCCACATTTCTGAATCCC | 70 | 312 |
| 780187 | 1796 | 1815 | 52710 | 52729 | TTTAATCCACATTTCTGAAT | 80 | 313 |
| 780188 | 1826 | 1845 | 52740 | 52759 | TCAGGAAAATGTACAATAGA | 128 | 314 |
| 780189 | 1873 | 1892 | 52787 | 52806 | GAAGCACTGAATCCATAGCA | 34 | 315 |
| 780190 | 1919 | 1938 | N/A | N/A | CCCAGACACTGAATTTCTTG | 56 | 37 |
| 780191 | 1963 | 1982 | 53003 | 53022 | TGAACACATTCTTCTTTGTA | 64 | 316 |
| 780192 | 2009 | 2028 | 53049 | 53068 | TATAAGCTGGAAACCAGAAT | 86 | 317 |
| 780193 | 2053 | 2072 | N/A | N/A | TCTGAAATCCTTTAGTCTGT | 106 | 318 |
| 780194 | 2097 | 2116 | 56031 | 56050 | CAGCTTAGAAAAAGATGCTG | 66 | 319 |
| 780195 | 2141 | 2160 | 56075 | 56094 | GACATTTGATGGAATATTAC | 45 | 320 |
| 780196 | 2185 | 2204 | N/A | N/A | AGAGGTTTAGAAACTGTTGA | 44 | 321 |
| 780197 | 2229 | 2248 | 56237 | 56256 | TTTTAAGTAATCATCCATAG | 70 | 322 |
| 780198 | 2273 | 2292 | 56281 | 56300 | ATGATGCTGTTATTCTGATC | 71 | 323 |
| 780199 | 2317 | 2336 | 56325 | 56344 | TTGCTTGATTGGCATCTGCT | 41 | 324 |
| 780200 | 2356 | 2375 | N/A | N/A | CTTTCTCACATACCTGACAA | 59 | 325 |

TABLE 3-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780201 | 2359 | 2378 | N/A | N/A | TCTCTTTCTCACATACCTGA | 50 | 326 |
| 780254 | 4111 | 4130 | 86606 | 86625 | GTTTCATTCGGTTATAAGGC | 36 | 235 |

TABLE 4

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 28 | 73 |
| 693430 | 5537 | 5556 | 100526 | 100545 | GCCCATTTCTTCAACAGAGT | 25 | 89 |
| 780254 | 4111 | 4130 | 86606 | 86625 | GTTTCATTCGGTTATAAGGC | 23 | 235 |
| 780276 | 4929 | 4948 | 93390 | 93409 | CTGTGCCATGATTTTACAAA | 62 | 327 |
| 780277 | 4973 | 4992 | 98121 | 98140 | CCCTTAGGGTGTTTTGGACA | 65 | 328 |
| 780278 | 5019 | 5038 | 98167 | 98186 | CCTTTTTTTGAAAGAAATT | 154 | 329 |
| 780279 | 5063 | 5082 | 98211 | 98230 | TCTAGGAGCTTAAAATACTG | 112 | 330 |
| 780280 | 5109 | 5128 | 98257 | 98276 | AACCAGCAAATATTCTTCTC | 83 | 331 |
| 780281 | 5169 | 5188 | 99175 | 99194 | TTCAGAGTTCTCACAATGGG | 72 | 332 |
| 780282 | 5217 | 5236 | 99223 | 99242 | CCAAAATCCCATTGGAAAAT | 88 | 333 |
| 780283 | 5261 | 5280 | 99267 | 99286 | AGCATGTAAGGTGAAATCTC | 88 | 334 |
| 780284 | 5305 | 5324 | 100157 | 100176 | GCCAATACATTCTGTTTGGG | 25 | 335 |
| 780285 | 5349 | 5368 | 100201 | 100220 | CAGACAATAAGCTTCAGGAG | 82 | 336 |
| 780286 | 5396 | 5415 | 100248 | 100267 | ATTTTTAAGAAACTCTCTGG | 86 | 337 |
| 780287 | 5440 | 5459 | 100429 | 100448 | CTTGGCCCAAAAGAATACAG | 69 | 338 |
| 780288 | 5488 | 5507 | 100477 | 100496 | GCAACCCAGGAAACCATTCT | 83 | 339 |
| 780289 | 5532 | 5551 | 100521 | 100540 | TTTCTTCAACAGAGTTTCTC | 157 | 340 |
| 780290 | 5535 | 5554 | 100524 | 100543 | CCATTTCTTCAACAGAGTTT | 64 | 341 |
| 780291 | 5539 | 5558 | 100528 | 100547 | ATGCCCATTTCTTCAACAGA | 59 | 342 |
| 780292 | 5542 | 5561 | 100531 | 100550 | ATAATGCCCATTTCTTCAAC | 135 | 343 |
| 780293 | 5577 | 5596 | 100566 | 100585 | GATTTTTGATGTTCTTCAC | 64 | 344 |
| 780294 | 5622 | 5641 | N/A | N/A | TAAGAGATCTCCTTCCTCTG | 77 | 345 |
| 780295 | 5666 | 5685 | 101304 | 101323 | ATCTGAGATATTGGAATGGT | 86 | 346 |
| 780296 | 5710 | 5729 | 101348 | 101367 | ACATAATATTTCTAGGCAGG | 48 | 347 |
| 780297 | 5754 | 5773 | 101392 | 101411 | GAGAAACTCTGGAGCTTGTT | 138 | 348 |
| 780298 | 5798 | 5817 | 106489 | 106508 | TCATAGGCTGCTCGGTAAAC | 109 | 349 |

TABLE 4-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780299 | 5842 | 5861 | 106533 | 106552 | GTGATGTATGTTTATTAAAA | 88* | 350 |
| 780300 | 5886 | 5905 | 113083 | 113102 | GTGGAGGTGGCAAAGCACCA | 50* | 351 |
| 780301 | 5946 | 5965 | 113143 | 113162 | CTCCATCACCAACATCCGGG | 121 | 352 |
| 780302 | 5990 | 6009 | 113187 | 113206 | TTGTCCTGCTGAAGCAGGCG | 136 | 353 |
| 780303 | 6034 | 6053 | 113231 | 113250 | CGTGGAGTGCAATCCTGTGC | 89 | 354 |
| 780304 | 6078 | 6097 | 118411 | 118430 | GTATATAATCATGGCTGAGT | 68 | 355 |
| 780305 | 6122 | 6141 | 118455 | 118474 | GGATACAGTGTGAAAAGCAG | 61 | 356 |
| 780306 | 6166 | 6185 | 118499 | 118518 | GAGCAATGCCGTAGTCAGCA | 61 | 357 |
| 780307 | 6170 | 6189 | 118503 | 118522 | TACTGAGCAATGCCGTAGTC | 75 | 358 |
| 780308 | 6173 | 6192 | 118506 | 118525 | CAGTACTGAGCAATGCCGTA | 61 | 359 |
| 780309 | 6175 | 6194 | 118508 | 118527 | AGCAGTACTGAGCAATGCCG | 58 | 360 |
| 780310 | 6177 | 6196 | 118510 | 118529 | ACAGCAGTACTGAGCAATGC | 70 | 361 |
| 780311 | 6180 | 6199 | 118513 | 118532 | TCTACAGCAGTACTGAGCAA | 88 | 362 |
| 780312 | 6211 | 6230 | 118544 | 118563 | CTGGTGTGCCCTCTGATGTT | 97 | 363 |
| 780313 | 6255 | 6274 | 124886 | 124905 | GTTATAAATGACATTTCCTC | 77 | 364 |
| 780314 | 6299 | 6318 | 124930 | 124949 | ATGTCATAGAGTAGTAAACC | 111 | 365 |
| 780315 | 6345 | 6364 | 124976 | 124995 | ATTTGGAAACTTCAAACCCT | 60 | 366 |
| 780316 | 6389 | 6408 | N/A | N/A | ACTGGATCAGGTAATTTTCC | 62 | 367 |
| 780317 | 6433 | 6452 | 126549 | 126568 | TTAATTTCTCAACCATAGGC | 120 | 368 |
| 780318 | 6477 | 6496 | 126593 | 126612 | AGAAGTAGGCCTTTCTTGAG | 95 | 369 |
| 780319 | 6521 | 6540 | 129666 | 129685 | AGACAGACTAATTCAGCTGA | 78 | 370 |
| 780320 | 6568 | 6587 | 129713 | 129732 | CCATGCATTCAACAATTACG | 57 | 371 |
| 780321 | 6612 | 6631 | 129757 | 129776 | GCCCAGCCAAATGCTTGCAT | 41 | 372 |
| 780322 | 6656 | 6675 | 129801 | 129820 | TTTAAGTCAAGAAATGAGAG | 92 | 373 |
| 780323 | 6700 | 6719 | 132410 | 132429 | ATATTCTACTATCAGCAACT | 97 | 374 |
| 780324 | 6744 | 6763 | 132454 | 132473 | CCAGCTTTCCTTTTCAACAG | 132 | 375 |
| 780325 | 6788 | 6807 | 132498 | 132517 | GTATTGATGACCAGGAGAGT | 92 | 376 |
| 780326 | 6832 | 6851 | 132542 | 132561 | AATCAGTCATCTTTTCTAGG | 98 | 377 |
| 780327 | 6876 | 6895 | N/A | N/A | TTTGCTTTGCTTGGAAAAGG | 85 | 378 |
| 780328 | 6920 | 6939 | 134252 | 134271 | GCTAACTTGCCATCAGCGGT | 84 | 379 |
| 780329 | 6964 | 6983 | 137368 | 137387 | AAGGAGCAGCTCCTTTAAGC | 65 | 380 |
| 780330 | 7008 | 7027 | 137412 | 137431 | ACACATCAATGGAGTACTGA | 51 | 381 |
| 780331 | 7052 | 7071 | 137456 | 137475 | CCCCACATTACATTTCTTTC | 124 | 382 |
| 780332 | 7096 | 7115 | 137500 | 137519 | TGGTGAAATCATTAGAAAAG | 119 | 383 |
| 780333 | 7141 | 7160 | N/A | N/A | CATAAGAAAACAGTTGGCTT | 61 | 384 |
| 780334 | 7185 | 7204 | 141546 | 141565 | AGTGTCTACCACCACTGTTA | 124 | 385 |

TABLE 4-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780335 | 7229 | 7248 | 141590 | 141609 | CACACTTCCACAACAGGGCT | 116 | 386 |
| 780336 | 7273 | 7292 | 141634 | 141653 | GCACGCAGTCTATTAGTCCA | 60 | 387 |
| 780337 | 7318 | 7337 | 142966 | 142985 | GTTTTGATTCCTTGTTTTCT | 92 | 388 |
| 780338 | 7362 | 7381 | 143010 | 143029 | CTGAAGGCAGAGGGTTTTCA | 78 | 389 |
| 780339 | 7406 | 7425 | 143054 | 143073 | AAAATATGGCCTCCTCCAGT | 82 | 390 |
| 780340 | 7457 | 7476 | 143105 | 143124 | CAAAAGTTGTAAATTACACG | 77 | 391 |
| 780341 | 7501 | 7520 | N/A | N/A | TAAGGCTTCCTAGCTGTGCT | 89 | 392 |
| 780342 | 7545 | 7564 | 145148 | 145167 | TTCAGTATTTTTCCGGTTGT | 121 | 393 |
| 780343 | 7589 | 7608 | 145758 | 145777 | CAAACGGTCAAGCAAGATTG | 138 | 394 |
| 780344 | 7636 | 7655 | 145805 | 145824 | CAATGTGTTTTTCTAAATTT | 102 | 395 |
| 780345 | 7688 | 7707 | 145857 | 145876 | TCTTACTCAACAGATGTTCG | 92 | 396 |
| 780346 | 7732 | 7751 | 145901 | 145920 | GAGGAGAGAATAATTTTCCT | 91 | 397 |
| 780347 | 7776 | 7795 | 145945 | 145964 | GAGTACCCTTTCCATGTGAA | 34 | 398 |
| 780348 | 7822 | 7841 | 145991 | 146010 | AAAATAATAACATTCCTTCA | 96 | 399 |
| 780349 | 7867 | 7886 | 146036 | 146055 | AAAATACACATTTACTGGTA | 115 | 400 |
| 780350 | 7912 | 7931 | 146081 | 146100 | CTGGTATTTATAAGAAATAT | 91 | 401 |
| 780351 | 7960 | 7979 | 146129 | 146148 | ATTAGGTACTTCACAGATTT | 140 | 402 |

TABLE 5

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 30 | 73 |
| 780254 | 4111 | 4130 | 86606 | 86625 | GTTTCATTCGGTTATAAGGC | 39 | 235 |
| 780352 | 8004 | 8023 | 146173 | 146192 | AACAAAAAATTATCGGCCTT | 79 | 403 |
| 780353 | 8052 | 8071 | 146221 | 146240 | CTTAAGCACAGAATTTAAAA | 94 | 404 |
| 780354 | 8096 | 8115 | 146265 | 146284 | ATACCGTGCAGATTTCTAGA | 91 | 405 |
| 780355 | 8140 | 8159 | 146309 | 146328 | AAGAAGGAATACATTACATG | 148 | 406 |
| 780356 | 8186 | 8205 | 146355 | 146374 | TTTGAATATTTACAAGCATA | 163 | 407 |
| 780357 | 8201 | 8220 | 146370 | 146389 | ATTAGTGCAAATTCATTTGA | 79 | 408 |
| 780358 | 8206 | 8225 | 146375 | 146394 | ACTTTATTAGTGCAAATTCA | 118 | 409 |
| 780359 | 8211 | 8230 | 146380 | 146399 | AAAGGACTTTATTAGTGCAA | 48 | 410 |
| 780360 | 8216 | 8235 | 146385 | 146404 | CCAACAAAGGACTTTATTAG | 75 | 411 |

TABLE 5-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780361 | 8221 | 8240 | 146390 | 146409 | ACATACCAACAAAGGACTTT | 98 | 412 |
| 780362 | 8231 | 8250 | 146400 | 146419 | AAGAGAATTCACATACCAAC | 164 | 413 |
| 780363 | 8275 | 8294 | 146444 | 146463 | AATTGAGTGAAGTTGTGTAA | 133 | 414 |
| 780364 | 8319 | 8338 | 146488 | 146507 | ATGTCATGTTTTTCATTAG | 157 | 415 |
| 780365 | 8364 | 8383 | 146533 | 146552 | AAAGAGAGTTTCTGTGTCTT | 146 | 416 |
| 780366 | 8408 | 8427 | 146577 | 146596 | ACAACTCTATTATGTCTAGG | 161 | 417 |
| 780367 | 8452 | 8471 | 146621 | 146640 | TATACAAAATTCAGGGTATC | 94 | 418 |
| 780368 | 8515 | 8534 | 146684 | 146703 | TAGTGGTATGAATAAAAAA | 107 | 419 |
| 780369 | 8561 | 8580 | 146730 | 146749 | AGATGAATATAAGCATTAGA | 98 | 420 |
| 780370 | 8605 | 8624 | 146774 | 146793 | TATCTGAATGATGTAGGATC | 118 | 421 |
| 780371 | 8650 | 8669 | 146819 | 146838 | GTAGGAGCTGTGGAATTCTA | 125 | 422 |
| 780372 | 8694 | 8713 | 146863 | 146882 | CTTCAGCAACTGAAAAGTGT | 132 | 423 |
| 780373 | 8741 | 8760 | 146910 | 146929 | CTAGGGTGGCAGATATTTTT | 126 | 424 |
| 780374 | 8785 | 8804 | 146954 | 146973 | TATTGTGGTAAGCTATGTAA | 106 | 425 |
| 780375 | 8829 | 8848 | 146998 | 147017 | AAATGACCTCAAATTATTAC | 84 | 426 |
| 780376 | 8873 | 8892 | 147042 | 147061 | GGTCAGGGCCAAAGAATTTA | 130 | 427 |
| 780377 | 8917 | 8936 | 147086 | 147105 | ACTAGTTGTCCTATCACAGG | 81 | 428 |
| 780378 | 8962 | 8981 | 147131 | 147150 | GTTTTCACATAGTAAAATGC | 47 | 429 |
| 780379 | 9006 | 9025 | 147175 | 147194 | TCATCTTTAAGAATTTGATT | 94 | 430 |
| 780380 | 9050 | 9069 | 147219 | 147238 | ATAACAAGTTAAAGCATAGC | 58 | 431 |
| 780381 | 9094 | 9113 | 147263 | 147282 | CTGGAACAAAGAGCTCTATT | 97 | 432 |
| 780382 | 9143 | 9162 | 147312 | 147331 | CTTTGGTAAAAAAAATTGCA | 125 | 433 |
| 780383 | 9183 | 9202 | 147352 | 147371 | ATTATTCCATTTAAATATGG | 125 | 434 |
| 780384 | 9188 | 9207 | 147357 | 147376 | CCTTTATTATTCCATTTAAA | 77 | 435 |
| 780385 | 9193 | 9212 | 147362 | 147381 | AAAAACCTTTATTATTCCAT | 93 | 436 |
| 780386 | N/A | N/A | 82225 | 82244 | CCTCTTTCAGTTTATTGTGA | 87 | 437 |
| 780387 | N/A | N/A | 82365 | 82384 | ATAGTTGACAGGAATTTATA | 71 | 438 |
| 780388 | N/A | N/A | 82505 | 82524 | GTTTAGTGGAAGTATTAAGG | 51 | 439 |
| 780389 | N/A | N/A | 82645 | 82664 | TATATGATAACATCACACAT | 106 | 440 |
| 780390 | N/A | N/A | 82785 | 82804 | TTCCATAGAACACTCTTTAT | 219 | 441 |
| 780391 | N/A | N/A | 82925 | 82944 | AGGAAATTATGCTGTGTTAC | 108 | 442 |
| 780392 | N/A | N/A | 83065 | 83084 | AGAAAAATGGTTTATTTAAG | 96 | 443 |
| 780394 | N/A | N/A | 79043 | 79062 | ACACTGACCATACACAAGCT | 100 | 444 |
| 780395 | N/A | N/A | 143142 | 143161 | GCCTAGCTGTGCTGTCATCA | 126 | 445 |
| 780396 | N/A | N/A | 143282 | 143301 | TACCAGTCTTATGTTTCACT | 108 | 446 |
| 780397 | N/A | N/A | 143422 | 143441 | ATTTCCCATTTTTGCCTTAG | 62 | 447 |

TABLE 5-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780398 | N/A | N/A | 143565 | 143584 | TGTATTGCTGCAAGAAAAAA | 90 | 448 |
| 780399 | N/A | N/A | 143705 | 143724 | ACGCAAATATATTTATGCAG | 74 | 449 |
| 780400 | N/A | N/A | 143845 | 143864 | ATGTTCAAAACATTCATTAT | 137 | 450 |
| 780401 | N/A | N/A | 143985 | 144004 | TAATAGTTTACAGTCATTAA | 111 | 451 |
| 780402 | N/A | N/A | 144125 | 144144 | TATAACTTCAGTTATAAGCA | 92 | 452 |
| 780403 | N/A | N/A | 144265 | 144284 | AGACAAGCAAGATCTGGTAG | 118 | 453 |
| 780404 | N/A | N/A | 144405 | 144424 | ACAGGAGCTAACATTTCAAA | 123 | 454 |
| 780405 | N/A | N/A | 144553 | 144572 | AACCGTCTTGGAGTTTATAT | 56 | 455 |
| 780406 | N/A | N/A | 144694 | 144713 | TATACTGATACTATGTCAAA | 193 | 456 |
| 780407 | N/A | N/A | 144834 | 144853 | CAGTATTTATACATTACCCT | 150 | 457 |
| 780408 | N/A | N/A | 144974 | 144993 | TTTTCTAGGTGACCCTTCAA | 119 | 458 |
| 780409 | N/A | N/A | 145168 | 145187 | CCTTTCTGCTTTTGTGTACC | 93 | 459 |
| 780410 | N/A | N/A | 145310 | 145329 | AAGTTCTTTACACTATAAAC | 112 | 460 |
| 780411 | N/A | N/A | 145450 | 145469 | GACATTATGTAGATATAGAT | 80 | 461 |
| 780412 | N/A | N/A | 145597 | 145616 | ATTATTATTTATAAAAAACT | 124 | 462 |
| 780413 | N/A | N/A | 145740 | 145759 | TGTATCTCTAGAAAAAGAAA | 111 | 463 |
| 780414 | N/A | N/A | 3862 | 3881 | AATCACAGTCAGAGGTTCCT | 120 | 464 |
| 780415 | N/A | N/A | 4122 | 4141 | CCCTTTTCCAAACTATTCAT | 119 | 465 |
| 780416 | N/A | N/A | 4157 | 4176 | GTGACAAAGTTGCATTTTAT | 108 | 466 |
| 780417 | N/A | N/A | 4174 | 4193 | TCTACAAGAGTTTGCTAGTG | 97 | 467 |
| 780418 | N/A | N/A | 4185 | 4204 | AAGTGCTGAACTCTACAAGA | 134 | 468 |
| 780419 | N/A | N/A | 6986 | 7005 | CTCTCACTTCGCTATGACAG | 116 | 469 |
| 780420 | N/A | N/A | 7557 | 7576 | AACCGTCAATTTTCTAAAGA | 110 | 470 |
| 780421 | N/A | N/A | 7842 | 7861 | CTATTCAATTAAAAGCTTAT | 122 | 471 |
| 780422 | N/A | N/A | 8002 | 8021 | CTCAAGGAAAAAACCTGTTT | 125 | 472 |
| 780423 | N/A | N/A | 8263 | 8282 | AAAGGCGGCAATTTCTGATA | 130 | 473 |
| 780424 | N/A | N/A | 8791 | 8810 | TATACTTGACATGGTCAAAA | 177 | 474 |
| 780425 | N/A | N/A | 8820 | 8839 | CTCCAATTCATTCTATTATA | 89 | 475 |
| 780426 | N/A | N/A | 11028 | 11047 | AACATAGCTGGTAAAATTAC | 143 | 476 |
| 780427 | N/A | N/A | 11977 | 11996 | AAACATTCAATGAATAGAAG | 86 | 477 |
| 780428 | N/A | N/A | 12155 | 12174 | ACGGAAGAAATTTTTCTTCA | 116 | 478 |

TABLE 6

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 38 | 73 |
| 780254 | 4111 | 4130 | 86606 | 86625 | GTTTCATTCGGTTATAAGGC | 18 | 235 |
| 780429 | N/A | N/A | 12244 | 12263 | CCAGTCTTCGATTCTCTGCC | 135 | 479 |
| 780430 | N/A | N/A | 12353 | 12372 | TTGGCTTTACATTATTGGAA | 41 | 480 |
| 780431 | N/A | N/A | 12761 | 12780 | GTGGCCGTTGCTCACGCCTG | 130 | 481 |
| 780432 | N/A | N/A | 12910 | 12929 | TCTTAGACATGTTGATATAT | 136 | 482 |
| 780433 | N/A | N/A | 14791 | 14810 | TCTTAGCAGGACTGATGAGG | 75 | 483 |
| 780434 | N/A | N/A | 15592 | 15611 | CAAATCAATTCATTACCAAG | 91 | 484 |
| 780435 | N/A | N/A | 15874 | 15893 | GCTCTAGATCTTTATAAATG | 102 | 485 |
| 780436 | N/A | N/A | 16258 | 16277 | TACTTTTCCCAGTATAAGCC | 114 | 486 |
| 780437 | N/A | N/A | 16448 | 16467 | CCTTATGCCTTGTTAAGCAA | 84 | 487 |
| 780438 | N/A | N/A | 16899 | 16918 | GAAATTAGACTGGTAAACTG | 113 | 488 |
| 780439 | N/A | N/A | 16920 | 16939 | ATCCCATTCTGGGAACTGCA | 61 | 489 |
| 780440 | N/A | N/A | 17294 | 17313 | TTGTATTCCTTGCAAAATGT | 123 | 490 |
| 780441 | N/A | N/A | 17451 | 17470 | TTAGTTGCAAGATAGAACAT | 82 | 491 |
| 780442 | N/A | N/A | 17796 | 17815 | ATGGTCTAGTTTCCACAGTA | 44 | 492 |
| 780443 | N/A | N/A | 18025 | 18044 | AGTAAGTTCCATTTGGAGTC | 61 | 493 |
| 780444 | N/A | N/A | 18279 | 18298 | GGGAAATTCTAGAGAAAACT | 64 | 494 |
| 780445 | N/A | N/A | 18439 | 18458 | TGTGAAGCAGCCCTTCCTAA | 128 | 495 |
| 780446 | N/A | N/A | 19114 | 19133 | ACTTCAGGTCACACCTTCAT | 66 | 496 |
| 780447 | N/A | N/A | 19502 | 19521 | CACATCAAATTAATTTCTTC | 95 | 497 |
| 780448 | N/A | N/A | 19553 | 19572 | AAACAGAATATGAACCATTA | 129 | 498 |
| 780449 | N/A | N/A | 19583 19556 | 19602 19575 | ACAAAACAGAATATGAACCA | 71 | 499 |
| 780450 | N/A | N/A | 19586 19559 | 19605 19578 | AAAACAAAACAGAATATGAA | 143 | 500 |
| 780451 | N/A | N/A | 19589 19562 | 19608 19581 | TACAAAACAAAACAGAATAT | 190 | 501 |
| 780452 | N/A | N/A | 19592 | 19611 | TGTGGATAAGAAAACATTGT | 119 | 502 |
| 780453 | N/A | N/A | 19953 20195 | 19972 20214 | TCTTGACTTTTGCATTATGA | 76 | 503 |
| 780454 | N/A | N/A | 20454 22583 | 20473 22602 | AAATGTTAACTGTTCTTTTT | 60 | 504 |
| 780455 | N/A | N/A | 20713 | 20732 | TCAGCTATGACCTGTTTCCT | 34 | 505 |
| 780456 | N/A | N/A | 20716 | 20735 | AAATCAGCTATGACCTGTTT | 128 | 506 |
| 780457 | N/A | N/A | 21493 | 21512 | GTAAAAATACTATGCTGTT | 87 | 507 |
| 780458 | N/A | N/A | 22339 | 22358 | CAAACATTAACAATTTTGCT | 118 | 508 |
| 780459 | N/A | N/A | 23396 | 23415 | ACCTCTAATAAATTGTGCTG | 73 | 509 |

TABLE 6-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780460 | N/A | N/A | 23640 | 23659 | GCATGGAATAGTAAAGGCCC | 61 | 510 |
| 780461 | N/A | N/A | 23970 | 23989 | ATTGCTAGGTAGAGAACTTA | 50 | 511 |
| 780462 | N/A | N/A | 24452 | 24471 | TCTAATAAATGACCAAGTTA | 76 | 512 |
| 780463 | N/A | N/A | 24633 | 24652 | GAACTTTATATATAGTTATC | 92 | 513 |
| 780464 | N/A | N/A | 24916 | 24935 | CTTGTGGGAAAGCATGAATC | 67 | 514 |
| 780465 | N/A | N/A | 25082 | 25101 | TCCAACAGTTAACGATCATT | 51 | 515 |
| 780466 | N/A | N/A | 25273 | 25292 | GATATAATCATGATACTAGA | 57 | 516 |
| 780467 | N/A | N/A | 25433 | 25452 | CAGTTTTAGTCATATAACAA | 108 | 517 |
| 780468 | N/A | N/A | 25435 | 25454 | TACAGTTTTAGTCATATAAC | 155 | 518 |
| 780469 | N/A | N/A | 25637 25667 25697 25727 | 25656 25686 25716 25746 | ATATGTATATTTATATACAT | 171 | 519 |
| 780470 | N/A | N/A | 25640 25670 25700 25730 25794 25858 | 25659 25689 25719 25749 25813 25877 | TAAATATGTATATTTATATA | 149 | 520 |
| 780471 | N/A | N/A | 25643 25673 25703 25733 25797 25861 | 25662 25692 25722 25752 25816 25880 | GTATAAATATGTATATTTAT | 163 | 521 |
| 780472 | N/A | N/A | 25646 25676 25706 25736 25800 25864 | 25665 25695 25725 25755 25819 25883 | TGTGTATAAATATGTATATT | 96 | 522 |
| 780473 | N/A | N/A | 25649 25679 25709 25739 25803 25867 | 25668 25698 25728 25758 25822 25886 | ATCTGTGTATAAATATGTAT | 106 | 523 |
| 780474 | N/A | N/A | 25652 25682 25712 25742 25806 25870 | 25671 25701 25731 25761 25825 25889 | TACATCTGTGTATAAATATG | 138 | 524 |
| 780475 | N/A | N/A | 25655 25685 25715 25745 25809 25873 | 25674 25704 25734 25764 25828 25892 | ATATACATCTGTGTATAAAT | 179 | 525 |
| 780476 | N/A | N/A | 25658 25688 25718 25748 | 25677 25707 25737 25767 | TTTATATACATCTGTGTATA | 129 | 526 |

TABLE 6-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| | | | 25812 | 25831 | | | |
| | | | 25876 | 25895 | | | |
| 780477 | N/A | N/A | 25661 | 25680 | ATATTTATATACATCTGTGT | 66 | 527 |
| | | | 25691 | 25710 | | | |
| | | | 25721 | 25740 | | | |
| | | | 25751 | 25770 | | | |
| | | | 25815 | 25834 | | | |
| | | | 25879 | 25898 | | | |
| 780478 | N/A | N/A | 25664 | 25683 | TGTATATTTATATACATCTG | 55 | 528 |
| | | | 25694 | 25713 | | | |
| | | | 25724 | 25743 | | | |
| | | | 25754 | 25773 | | | |
| | | | 25818 | 25837 | | | |
| | | | 25882 | 25901 | | | |
| 780479 | N/A | N/A | 25755 | 25774 | TTGTATATTTATATACATCT | 88 | 529 |
| | | | 25819 | 25838 | | | |
| | | | 25883 | 25902 | | | |
| 780480 | N/A | N/A | 25758 | 25777 | TATTTGTATATTTATATACA | 164 | 530 |
| | | | 25822 | 25841 | | | |
| | | | 25886 | 25905 | | | |
| 780481 | N/A | N/A | 25761 | 25780 | TTATATTTGTATATTTATAT | 156 | 531 |
| | | | 25825 | 25844 | | | |
| | | | 25889 | 25908 | | | |
| 780482 | N/A | N/A | 25764 | 25783 | TATTTATATTTGTATATTTA | 178 | 532 |
| | | | 25828 | 25847 | | | |
| | | | 25892 | 25911 | | | |
| 780483 | N/A | N/A | 25767 | 25786 | ATATATTTATATTTGTATAT | 96 | 533 |
| | | | 25831 | 25850 | | | |
| | | | 25895 | 25914 | | | |
| 780484 | N/A | N/A | 25770 | 25789 | TGTATATATTTATATTTGTA | 110 | 534 |
| | | | 25834 | 25853 | | | |
| | | | 25898 | 25917 | | | |
| 780485 | N/A | N/A | 25773 | 25792 | AAATGTATATATTTATATTT | 102 | 535 |
| | | | 25837 | 25856 | | | |
| | | | 25901 | 25920 | | | |
| 780486 | N/A | N/A | 25776 | 25795 | TATAAATGTATATATTTATA | 144 | 536 |
| | | | 25840 | 25859 | | | |
| | | | 25904 | 25923 | | | |
| 780487 | N/A | N/A | 25779 | 25798 | ATATATAAATGTATATATTT | 122 | 537 |
| | | | 25843 | 25862 | | | |
| | | | 25907 | 25926 | | | |
| 780488 | N/A | N/A | 25782 | 25801 | TTTATATATAAATGTATATA | 106 | 538 |
| | | | 25846 | 25865 | | | |
| | | | 25910 | 25929 | | | |
| 780489 | N/A | N/A | 25785 | 25804 | ATATTTATATATAAATGTAT | 139 | 539 |
| | | | 25849 | 25868 | | | |
| | | | 25913 | 25932 | | | |
| 780490 | N/A | N/A | 25788 | 25807 | TGTATATTTATATATAAATG | 98 | 540 |
| | | | 25852 | 25871 | | | |
| 780491 | N/A | N/A | 25791 | 25810 | ATATGTATATTTATATATAA | 110 | 541 |
| | | | 25855 | 25874 | | | |
| 780492 | N/A | N/A | 26102 | 26121 | CCATGTTTAGAAGAAATACT | 57 | 542 |
| 780493 | N/A | N/A | 26738 | 26757 | ATTACATAGTTTGGCAAAAC | 107 | 543 |

TABLE 6-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780494 | N/A | N/A | 27287 | 27306 | ACTGCAGAAATATGTACCTT | 89 | 544 |
| 780495 | N/A | N/A | 27387 | 27406 | CACCCCAGGAAGAAGTCCCA | 100 | 545 |
| 780496 | N/A | N/A | 27872 | 27891 | GTTAAATTACCTTTAACATA | 174 | 546 |
| 780497 | N/A | N/A | 28186 | 28205 | TCCTTGAAAGTATCCTCTAC | 90 | 547 |
| 780498 | N/A | N/A | 29148 | 29167 | CCATCCTATCCAGATAAATA | 137 | 548 |
| 780499 | N/A | N/A | 29220 | 29239 | AGGTGTGCTTTAGGAGAAGC | 34 | 549 |
| 780500 | N/A | N/A | 32958 | 32977 | TTATTAAGGCAGAACTCCAA | 92 | 550 |
| 780501 | N/A | N/A | 33224 | 33243 | CATCCCAAGTGCCTACAGAC | 146 | 551 |
| 780502 | N/A | N/A | 34124 | 34143 | ACTTTGAAAGTGGCAGAAAA | 125 | 552 |
| 780503 | N/A | N/A | 34685 | 34704 | TTACAGTTATTTTCACAAAG | 89 | 553 |
| 780504 | N/A | N/A | 34756 | 34775 | CAAACATTATAATTTCTATA | 195 | 554 |
| 780505 | N/A | N/A | 34881 | 34900 | TATAAGCATGTGGAGGTATC | 90 | 555 |

TABLE 7

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 49 | 73 |
| 780254 | 4111 | 4130 | 86606 | 86625 | GTTTCATTCGGTTATAAGGC | 33 | 235 |
| 780506 | N/A | N/A | 35751 | 35770 | TGCTATGTGCTATACAATTA | 75 | 556 |
| 780507 | N/A | N/A | 36381 | 36400 | CTTACAAGTCTGCAGTTACG | 72 | 557 |
| 780508 | N/A | N/A | 36600 | 36619 | TGCCCAGAATCTACAGAATC | 99 | 558 |
| 780509 | N/A | N/A | 36661 | 36680 | TCCAGGGCTGCAACTGTACA | 107 | 559 |
| 780510 | N/A | N/A | 36909 | 36928 | GTTCTGTGGACACTGAGATA | 91 | 560 |
| 780511 | N/A | N/A | 36965 | 36984 | GCTTTGCTTGTTAACTGAAA | 66 | 561 |
| 780512 | N/A | N/A | 37065 | 37084 | TTTCTCTCAGGTATTTAAGC | 74 | 562 |
| 780513 | N/A | N/A | 37116 | 37135 | GACTTCTTATAAGGTATTTT | 65 | 563 |
| 780514 | N/A | N/A | 37198 | 37217 | GGCTGGTACCCAAACTTGTC | 91 | 564 |
| 780515 | N/A | N/A | 37201 | 37220 | CAAGGCTGGTACCCAAACTT | 72 | 565 |
| 780516 | N/A | N/A | 37303 | 37322 | ACAATCCCAGCAGGTAGGTG | 57 | 566 |
| 780517 | N/A | N/A | 37333 | 37352 | ATCCTTCTGACCTACGATGG | 72 | 567 |
| 780518 | N/A | N/A | 37398 | 37417 | CTTTGAACTCATAAGATAGA | 83 | 568 |
| 780519 | N/A | N/A | 37548 | 37567 | GCTTATTGAAAGACTGATCT | 88 | 569 |
| 780520 | N/A | N/A | 38071 | 38090 | GAAGGAAGAGAACAGGTATG | 94 | 570 |

TABLE 7-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780521 | N/A | N/A | 38396 | 38415 | CGCCTCTCTCACGCTGCCTG | 92 | 571 |
| 780522 | N/A | N/A | 38720 | 38739 | TGCAAACAATTTTAATAAAC | 96 | 572 |
| 780523 | N/A | N/A | 38837 | 38856 | TGACTACCATGGACCTCCAA | 83 | 573 |
| 780524 | N/A | N/A | 38855 | 38874 | CCTTCACTGGGTCTCACTTG | 91 | 574 |
| 780525 | N/A | N/A | 39213 | 39232 | ACTAAGCTGAAACTATGAAT | 104 | 575 |
| 780526 | N/A | N/A | 39521 | 39540 | CTGATTGATTGTTAACTAAC | 79 | 576 |
| 780527 | N/A | N/A | 40301 | 40320 | TTATAAGTAAGTAGATTTGA | 111 | 577 |
| 780528 | N/A | N/A | 40577 | 40596 | AGATTGTTGCACAAATATTT | 95 | 578 |
| 780529 | N/A | N/A | 40733 | 40752 | TACTATTCAAATGGATATAA | 116 | 579 |
| 780530 | N/A | N/A | 41316 | 41335 | GAACTATGCTAAAAACACTA | 90 | 580 |
| 780531 | N/A | N/A | 41593 | 41612 | TTTTGTGTGAGTAGGCTGTG | 83 | 581 |
| 780532 | N/A | N/A | 42005 | 42024 | TATATTCAACATACCCTGTT | 100 | 582 |
| 780533 | N/A | N/A | 43265 | 43284 | TACAACATAAATTCTTGCCA | 57 | 583 |
| 780534 | N/A | N/A | 45337 | 45356 | AATCTTACTGTCAATATAGT | 101 | 584 |
| 780535 | N/A | N/A | 45380 | 45399 | TTAAAAGGAAGTAACCATGT | 44 | 585 |
| 780536 | N/A | N/A | 45462 | 45481 | TGGTATCCCTCCTAAGTGCT | 55 | 586 |
| 780537 | N/A | N/A | 45650 | 45669 | CTCTCTTGGCTCCCGACTGC | 75 | 587 |
| 780538 | N/A | N/A | 46047 | 46066 | TACCTTATTTGGAACTCTGC | 86 | 588 |
| 780539 | N/A | N/A | 46543 | 46562 | TTACTTATATGTAATTTGTT | 77 | 589 |
| 780540 | N/A | N/A | 46567 | 46586 | CATCCTGTAAACCTTTTTTA | 79 | 590 |
| 780541 | N/A | N/A | 47702 | 47721 | AAAGATTAAATTAAGCTGCA | 121 | 591 |
| 780542 | N/A | N/A | 47812 | 47831 | ACATTAGGAATCTCACCTCA | 71 | 592 |
| 780543 | N/A | N/A | 48404 | 48423 | CTGAATATAAATATTATCTA | 229 | 593 |
| 780544 | N/A | N/A | 48835 | 48854 | ATGTATAGCTAGAATGAGGA | 99 | 594 |
| 780545 | N/A | N/A | 48873 | 48892 | AGATGCAACTCAAGAAAACT | 81 | 595 |
| 780546 | N/A | N/A | 48947 50077 | 48966 50096 | TATTTATAAAGCACCTATCT | 85 | 596 |
| 780547 | N/A | N/A | 50094 | 50113 | AAATTATATCAAATTGATAT | 73 | 597 |
| 780548 | N/A | N/A | 51550 | 51569 | TTTTATAGAGGCTGAGGAGA | 98 | 598 |
| 780549 | N/A | N/A | 52154 | 52173 | GCCAAACTTTAAAGATGCAG | 33 | 599 |
| 780550 | N/A | N/A | 53367 | 53386 | CGAATAAACTCAGCTAGCTG | 87 | 600 |
| 780551 | N/A | N/A | 53543 | 53562 | GACAGTTATTATATATCATG | 42 | 601 |
| 780552 | N/A | N/A | 53603 | 53622 | AAATTTATTCTTAATCTCCC | 79 | 602 |

TABLE 7-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780553 | N/A | N/A | 54774 | 54793 | AAAACAAGTGAATGCTACAG | 92 | 603 |
| 780554 | N/A | N/A | 54886 | 54905 | CTCTTATGATGCTGAGTATC | 108 | 604 |
| 780555 | N/A | N/A | 55333 | 55352 | ATGTTTTAATGAAAGATTGG | 86 | 605 |
| 780556 | N/A | N/A | 55870 | 55889 | TTAACTATAGATATATTGGG | 80 | 606 |
| 780557 | N/A | N/A | 55936 | 55955 | GGCAAAATGAATAAACAGTA | 94 | 607 |
| 780558 | N/A | N/A | 56363 | 56382 | TTGAATATTTACCTGACAAA | 107 | 608 |
| 780559 | N/A | N/A | 56837 | 56856 | AGTGTTACACAACTTTGGCC | 120 | 609 |
| 780560 | N/A | N/A | 56947 | 56966 | GAGGGCTTTAAAGAAAGATA | 97 | 610 |
| 780561 | N/A | N/A | 57738 | 57757 | TGTAGTACAGTTGTATCAGG | 84 | 611 |
| 780562 | N/A | N/A | 57907 | 57926 | TAAACCTAATACATAATCCT | 81 | 612 |
| 780563 | N/A | N/A | 57911 | 57930 | TCTTTAAACCTAATACATAA | 102 | 613 |
| 780564 | N/A | N/A | 59330 | 59349 | ATTAGAACCTACTGGACCTT | 89 | 614 |
| 780565 | N/A | N/A | 60045 | 60064 | TTTTCTCTAAGATATGCCAT | 78 | 615 |
| 780566 | N/A | N/A | 60338 | 60357 | GCTCATAGCAAAATTAAAAG | 109 | 616 |
| 780567 | N/A | N/A | 60503 | 60522 | TTTCATTTAATGTAGCACTG | 101 | 617 |
| 780568 | N/A | N/A | 61046 | 61065 | AGCAACTGAGACTTGGATTT | 91 | 618 |
| 780569 | N/A | N/A | 62829 | 62848 | ACATTTAGTGTGAACAAATG | 77 | 619 |
| 780570 | N/A | N/A | 62985 | 63004 | TGCTAGTGAGTGCATCATAA | 120 | 620 |
| 780571 | N/A | N/A | 63074 | 63093 | TGGATGGGTACTTTTCTCTA | 74 | 621 |
| 780572 | N/A | N/A | 63219 | 63238 | AGGTAGAGAGAGAGTAACAC | 92 | 622 |
| 780573 | N/A | N/A | 63229 | 63248 | ATTTAGAGCTAGGTAGAGAG | 93 | 623 |
| 780574 | N/A | N/A | 63326 | 63345 | TGAGAAATAAAGTGCTATAG | 105 | 624 |
| 780575 | N/A | N/A | 63342 | 63361 | TGAATGGTAGTATATGTGAG | 84 | 625 |
| 780576 | N/A | N/A | 63662 | 63681 | ACATTGTGAGGTCAAAAAAG | 98 | 626 |
| 780577 | N/A | N/A | 64157 | 64176 | TCCCTCTCCAATGGGCCCAC | 74 | 627 |
| 780578 | N/A | N/A | 64433 | 64452 | TTCCAGAGTAATATGTTATG | 134 | 628 |
| 780579 | N/A | N/A | 64500 | 64519 | GATAAACCCCAAGAAGGCAA | 76 | 629 |
| 780580 | N/A | N/A | 64878 | 64897 | TACATTATGTATTAGCTCTA | 76 | 630 |
| 780581 | N/A | N/A | 65152 | 65171 | GTGTTCAAGTCATAGAAATG | 88 | 631 |
| 780582 | N/A | N/A | 65840 | 65859 | AACCAATTAGTATAACATTT | 75 | 632 |

TABLE 8

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 39 | 73 |
| 780254 | 4111 | 4130 | 86606 | 86625 | GTTTCATTCGGTTATAAGGC | 30 | 235 |
| 780583 | N/A | N/A | 66279 | 66298 | CTCATTTTTTGCCCTCTCAA | 55 | 633 |
| 780584 | N/A | N/A | 66413 | 66432 | TAATTTTCAAAGCGCATGAA | 66 | 634 |
| 780585 | N/A | N/A | 66417 | 66436 | ATGTTAATTTTCAAAGCGCA | 39 | 635 |
| 780586 | N/A | N/A | 66480 | 66499 | GAAGAAACTTTTTGGATAA | 72 | 636 |
| 780587 | N/A | N/A | 68762 | 68781 | AATAAATTTGGCAACTTATA | 126 | 637 |
| 780588 | N/A | N/A | 68885 | 68904 | GAGAAAGTAACACAAACAAT | 106 | 638 |
| 780589 | N/A | N/A | 69914 | 69933 | CAAATCCTCAATTACAACTT | 91 | 639 |
| 780590 | N/A | N/A | 69919 | 69938 | ACCAACAAATCCTCAATTAC | 98 | 640 |
| 780591 | N/A | N/A | 70220 | 70239 | GGAGATAGAGATCAACATTT | 55 | 641 |
| 780592 | N/A | N/A | 70279 | 70298 | AATTAAGGGCCATATACATA | 79 | 642 |
| 780593 | N/A | N/A | 72795 | 72814 | ACCCAATTATGAGGATAAAA | 41 | 643 |
| 780594 | N/A | N/A | 72902 | 72921 | TCATTTATTGGAGAAGAGGA | 115 | 644 |
| 780595 | N/A | N/A | 73395 | 73414 | AAACCAAACTATGGAGTTTA | 89 | 645 |
| 780596 | N/A | N/A | 75173 | 75192 | AAGTCCTGTCCTCAAAGAGT | 74 | 646 |
| 780597 | N/A | N/A | 75176 | 75195 | AACAAGTCCTGTCCTCAAAG | 99 | 647 |
| 780598 | N/A | N/A | 75470 | 75489 | AACAAACAAAGTGCCATCTA | 52 | 648 |
| 780599 | N/A | N/A | 75646 | 75665 | ATTATAGAGGCTTATTAACC | 83 | 649 |
| 780600 | N/A | N/A | 76096 | 76115 | TAGAGTTGAAAGCTTCCTTC | 65 | 650 |
| 780601 | N/A | N/A | 76298 | 76317 | CCATCTGAGGAACTTAAGTC | 67 | 651 |
| 780602 | N/A | N/A | 76349 | 76368 | GTCAAACTCTTCAGAGTCTG | 24 | 652 |
| 780603 | N/A | N/A | 76970 76997 | 76989 77016 | TATATAGTATATATATAATA | 138 | 653 |
| 780604 | N/A | N/A | 76973 77000 | 76992 77019 | TTATATATAGTATATATATA | 104 | 654 |
| 780605 | N/A | N/A | 76976 77003 | 76995 77022 | GTATTATATATAGTATATAT | 106 | 655 |
| 780606 | N/A | N/A | 76979 77006 | 76998 77025 | TAAGTATTATATATAGTATA | 105 | 656 |
| 780607 | N/A | N/A | 76982 77009 | 77001 77028 | TAATAAGTATTATATATAGT | 76 | 657 |
| 780608 | N/A | N/A | 76985 77012 | 77004 77031 | ATATAATAAGTATTATATAT | 78 | 658 |
| 780609 | N/A | N/A | 76988 77015 | 77007 77034 | TATATATAATAAGTATTATA | 126 | 659 |
| 780610 | N/A | N/A | 77524 | 77543 | TTTCATAGTTTTATAGCATT | 72 | 660 |
| 780611 | N/A | N/A | 77611 | 77630 | GTCTTATAGTTGGGAACGAA | 43 | 661 |
| 780612 | N/A | N/A | 78065 | 78084 | ACTATCATTTTAACCTCTGA | 71 | 662 |

TABLE 8-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780613 | N/A | N/A | 78080 | 78099 | ACAGTAGGCCAAGTAACTAT | 80 | 663 |
| 780614 | N/A | N/A | 78344 | 78363 | AAGTGATGATAATAATTTGC | 54 | 664 |
| 780615 | N/A | N/A | 78724 | 78743 | TGGCCAATATTCAGGAGGGT | 81 | 665 |
| 780616 | N/A | N/A | 78787 | 78806 | GCTTTGCTTACTAGTGAGTG | 70 | 666 |
| 780617 | N/A | N/A | 81581 87838 | 81600 87857 | GTTTGAAGGAATAGCTGACA | 60 | 667 |
| 780618 | N/A | N/A | 81584 87841 | 81603 87860 | AGTGTTTGAAGGAATAGCTG | 52 | 668 |
| 780619 | N/A | N/A | 81587 87844 | 81606 87863 | CATAGTGTTTGAAGGAATAG | 129 | 669 |
| 780620 | N/A | N/A | 81590 87847 | 81609 87866 | AGCCATAGTGTTTGAAGGAA | 40 | 670 |
| 780621 | N/A | N/A | 81593 87850 | 81612 87869 | AAAGCCATAGTGTTTGAAG | 91 | 671 |
| 780622 | N/A | N/A | 81596 87853 | 81615 87872 | CTAAAAGCCATAGTGTTTG | 85 | 672 |
| 780623 | N/A | N/A | 81599 87856 | 81618 87875 | ATTCTAAAAGCCATAGTGT | 117 | 673 |
| 780624 | N/A | N/A | 81630 87887 | 81649 87906 | GCAGCATCATGCAAGCAGCA | 31 | 674 |
| 780625 | N/A | N/A | 81633 87890 | 81652 87909 | ATTGCAGCATCATGCAAGCA | 81 | 675 |
| 780626 | N/A | N/A | 83145 | 83164 | TGGCGGAATGCAGAAATTTA | 61 | 676 |
| 780627 | N/A | N/A | 83842 | 83861 | GTGGGAAGGAAGAAATGTGC | 70 | 677 |
| 780628 | N/A | N/A | 84184 | 84203 | AGCATATTAATGCCAAATAT | 73 | 678 |
| 780629 | N/A | N/A | 84201 | 84220 | AAAGGCAAATGACACACAGC | 87 | 679 |
| 780630 | N/A | N/A | 84266 | 84285 | ATTAGTCTGGCTAAGAAGAA | 95 | 680 |
| 780631 | N/A | N/A | 84723 | 84742 | ACAGAGCTGAGGTCTGCAAC | 58 | 681 |
| 780632 | N/A | N/A | 84951 | 84970 | AAGCTCAGGAGTTCAGAAAA | 111 | 682 |
| 780633 | N/A | N/A | 86880 | 86899 | GGTTTCTGGATATTAGAACA | 76 | 683 |
| 780634 | N/A | N/A | 87013 | 87032 | TTGTCAGCAACCGATCAAAG | 82 | 684 |
| 780635 | N/A | N/A | 88098 | 88117 | CAATTTGGAGTCTACAATGA | 78 | 685 |
| 780636 | N/A | N/A | 88353 | 88372 | AAATGTAACCTTACGACATT | 77 | 686 |
| 780637 | N/A | N/A | 88867 | 88886 | TAATGCTAACAGCAACAAGG | 85 | 687 |
| 780638 | N/A | N/A | 89084 | 89103 | TCACCTTTACCCTTGTGATT | 57 | 688 |
| 780639 | N/A | N/A | 89635 | 89654 | CAGGCCAAATAGGACTCTAT | 51 | 689 |
| 780640 | N/A | N/A | 89998 | 90017 | AGTCATATTAGTTTCTAATT | 96 | 690 |
| 780641 | N/A | N/A | 90808 | 90827 | CTGCTCTGCTAATGGGCTGG | 54 | 691 |
| 780642 | N/A | N/A | 91043 | 91062 | TTCATGTATCTCTTAACCCA | 42 | 692 |
| 780643 | N/A | N/A | 91084 | 91103 | ACTTCCATATTTACCTGCAA | 105 | 693 |

TABLE 8-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780644 | N/A | N/A | 92608 | 92627 | TGCACTAAACTCATTTGACA | 98 | 694 |
| 780645 | N/A | N/A | 92700 | 92719 | GCATCATCTCAGGGAGCCAT | 45 | 695 |
| 780646 | N/A | N/A | 92957 | 92976 | CAGCATATCTCAGCATACCT | 51 | 696 |
| 780647 | N/A | N/A | 93284 | 93303 | CAAACAGTGAAACATGGAAT | 89 | 697 |
| 780648 | N/A | N/A | 93697 | 93716 | TTCAATTGACTAATTCAGTA | 85 | 698 |
| 780649 | N/A | N/A | 94459 | 94478 | GCTGATTGCAATGTTTCAAT | 33 | 699 |
| 780650 | N/A | N/A | 94553 | 94572 | AAATCACATTATCCATGACA | 78 | 700 |
| 780651 | N/A | N/A | 95499 | 95518 | AATAGCTGTCAGACAAGTTG | 64 | 701 |
| 780652 | N/A | N/A | 95576 | 95595 | TTAGAGCTTCTGCACCATGA | 91 | 702 |
| 780653 | N/A | N/A | 95725 | 95744 | TTCCACCTGATTAATTGAAT | 70 | 703 |
| 780654 | N/A | N/A | 96460 | 96479 | ATTTTTTAAAGAGTTTGTGC | 51 | 704 |
| 780655 | N/A | N/A | 96720 | 96739 | TATAAACTCATAGGCCCTGG | 74 | 705 |
| 780656 | N/A | N/A | 97174 | 97193 | GTTTAAGGAATACTTAAACA | 81 | 706 |
| 780657 | N/A | N/A | 97323 | 97342 | TGCCCTGAGAATGAAATAAC | 73 | 707 |
| 780658 | N/A | N/A | 97591 | 97610 | TTTGATGGATTCTACTTGCA | 83 | 708 |
| 780659 | N/A | N/A | 97610 | 97629 | CTCAAAGTAACTACTGCATT | 46 | 709 |

TABLE 9

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 38 | 73 |
| 780254 | 4111 | 4130 | 86606 | 86625 | GTTTCATTCGGTTATAAGGC | 27 | 235 |
| 780660 | N/A | N/A | 99313 | 99332 | TCTAAAAATCTAATAAGTCT | 89 | 710 |
| 780661 | N/A | N/A | 99451 | 99470 | TACTCCAAGGTTTTATGAGC | 81 | 711 |
| 780662 | N/A | N/A | 99569 | 99588 | AAGAGATAATTACAGTCCCT | 71 | 712 |
| 780663 | N/A | N/A | 99813 | 99832 | CTAAACGCAAAACTTTCTGA | 107 | 713 |
| 780664 | N/A | N/A | 100778 | 100797 | TAGAATACAAGATTTTATTG | 134 | 714 |
| 780665 | N/A | N/A | 102009 | 102028 | TGAGCACCTAAACATGCTAC | 65 | 715 |
| 780666 | N/A | N/A | 102270 | 102289 | ACAGCATCGCAGGTCTTGTA | 50 | 716 |
| 780667 | N/A | N/A | 102579 | 102598 | AATGCATTTCATAGTTGTCC | 60 | 717 |
| 780668 | N/A | N/A | 104248 | 104267 | TTCTCTATTTGAGAATCGCC | 64 | 718 |
| 780669 | N/A | N/A | 104621 | 104640 | AAATTTCAAGTTGGAGTAGG | 85 | 719 |
| 780670 | N/A | N/A | 105660 | 105679 | GTCATATAGTGGCCCCTAAA | 31 | 720 |

TABLE 9-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780671 | N/A | N/A | 106100 | 106119 | CACTGGTATGCCCTTCCAAC | 65 | 721 |
| 780672 | N/A | N/A | 106561 | 106580 | GAATTTCTTACTTGTCTTAA | 95 | 722 |
| 780673 | N/A | N/A | 107953 | 107972 | GCTACATAAAATAAATCACC | 79 | 723 |
| 780674 | N/A | N/A | 109817 | 109836 | AGAGTCTGAAGTATCTAGAA | 98 | 724 |
| 780675 | N/A | N/A | 110040 | 110059 | TGAAGCCTGGAACCAGTTTA | 94 | 725 |
| 780676 | N/A | N/A | 110227 | 110246 | CCTAAAGCCAATTAGCACAA | 101 | 726 |
| 780677 | N/A | N/A | 110637 | 110656 | AGTGTAGCCACTAAGAATTT | 88 | 727 |
| 780678 | N/A | N/A | 110978 | 110997 | CTTATACACTAATTGGCTCT | 66 | 728 |
| 780679 | N/A | N/A | 111011 | 111030 | TTTCTTCCACCATTCCCTTA | 101 | 729 |
| 780680 | N/A | N/A | 111182 | 111201 | CTCACTAATTGCAAAGAAAA | 109 | 730 |
| 780681 | N/A | N/A | 111343 | 111362 | CAAAGCTTCAGACTGTGATC | 70 | 731 |
| 780682 | N/A | N/A | 111843 | 111862 | TCAGAGAGGCCCGCCATGGG | 122 | 732 |
| 780683 | N/A | N/A | 111897 | 111916 | TTCACATGGCTGAAGTCTTG | 115 | 733 |
| 780684 | N/A | N/A | 112310 | 112329 | ATCTACTGAATTCTGGTTAG | 103 | 734 |
| 780685 | N/A | N/A | 112349 | 112368 | GCACACAGTGTAGTCATACT | 44 | 735 |
| 780686 | N/A | N/A | 114870 | 114889 | AACCCAAGATTCCCCCTGGT | 99 | 736 |
| 780687 | N/A | N/A | 115427 | 115446 | TGGAGAAGTAAGCTAACAGT | 109 | 737 |
| 780688 | N/A | N/A | 115958 | 115977 | TAACTGAAAATTCAAGCCTG | 115 | 738 |
| 780689 | N/A | N/A | 116039 | 116058 | CTTAAGGAAAATGAGCTCTC | 106 | 739 |
| 780690 | N/A | N/A | 116174 | 116193 | TATAATATCTAGCTTTCCCT | 95 | 740 |
| 780691 | N/A | N/A | 116253 | 116272 | CAGAGGGAGAAAAACACTGA | 110 | 741 |
| 780692 | N/A | N/A | 116357 | 116376 | CCCTTGAGGGTGTCACAATC | 82 | 742 |
| 780693 | N/A | N/A | 116374 | 116393 | ATCTTTGTATCTCTGCTCCC | 89 | 743 |
| 780694 | N/A | N/A | 116669 | 116688 | TTGAAATAATAAGTAAAGAT | 123 | 744 |
| 780695 | N/A | N/A | 116874 | 116893 | ATAAGACATGCCTCTTTAAG | 74 | 745 |
| 780696 | N/A | N/A | 117178 | 117197 | AGTACATATTATTTAACTGC | 61 | 746 |
| 780697 | N/A | N/A | 117306 | 117325 | ACTGTTGGTTTTGGCTCACA | 66 | 747 |
| 780698 | N/A | N/A | 117646 | 117665 | TCTGGAGACTGACCCACGCA | 73 | 748 |
| 780699 | N/A | N/A | 118398 | 118417 | GCTGAGTGGAGGTATCTGCC | 92 | 749 |
| 780700 | N/A | N/A | 119907 | 119926 | ATATGGTTTAGGAGAGACTA | 41 | 750 |
| 780701 | N/A | N/A | 121039 | 121058 | ATACTTAACTCATGGATAGA | 80 | 751 |
| 780702 | N/A | N/A | 121425 | 121444 | AAAAGTGCAATTGCCATAGG | 57 | 752 |
| 780703 | N/A | N/A | 121530 | 121549 | CCGGTAACATTTTATTTACC | 62 | 753 |
| 780704 | N/A | N/A | 121871 | 121890 | TCAATGTATTGTTGCCAAAT | 45 | 754 |
| 780705 | N/A | N/A | 122553 | 122572 | ATGAGCTACCCACACAGTCA | 78 | 755 |

TABLE 9-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780706 | N/A | N/A | 123081 | 123100 | TTGGAAGGATGGAGACATCG | 28 | 756 |
| 780707 | N/A | N/A | 123885 | 123904 | TGATATGGCATGATGTCTAC | 67 | 757 |
| 780708 | N/A | N/A | 124062 | 124081 | AGATGATATGCTATGACATA | 77 | 758 |
| 780709 | N/A | N/A | 124679 | 124698 | TGTCCTGTCTCATAACATCT | 68 | 759 |
| 780710 | N/A | N/A | 125144 | 125163 | AGAATATTTATGCACTAAAC | 71 | 760 |
| 780711 | N/A | N/A | 125277 | 125296 | GTTCTAACAGCAATTTCCTT | 78 | 761 |
| 780712 | N/A | N/A | 126145 | 126164 | ATCCTTATGTCCTCACAGAT | 89 | 762 |
| 780713 | N/A | N/A | 126446 | 126465 | TATTTCCTCTCAATGTTTAT | 125 | 763 |
| 780714 | N/A | N/A | 127216 | 127235 | TTAAAAAAAGGAATGGGATA | 92 | 764 |
| 780715 | N/A | N/A | 127242 | 127261 | CAACCTGAAAAAATTAGTCT | 79 | 765 |
| 780716 | N/A | N/A | 127360 | 127379 | ATAAATGAGTTGATCAGTGG | 83 | 766 |
| 780717 | N/A | N/A | 127443 | 127462 | TATTCCTGGATGAGAAAAAT | 103 | 767 |
| 780718 | N/A | N/A | 127460 | 127479 | CCTAAGACTGGTTAAAATAT | 91 | 768 |
| 780719 | N/A | N/A | 128188 | 128207 | ATAAGGAAAGTTGTTCTGGG | 108 | 769 |
| 780720 | N/A | N/A | 132660 | 132679 | ATGCAATAACAATTATGCAC | 75 | 770 |
| 780721 | N/A | N/A | 133278 | 133297 | GGAGTTGATATTTCAGGTAC | 81 | 771 |
| 780722 | N/A | N/A | 134443 | 134462 | TTTTCAGAGGATCTACTGTG | 90 | 772 |
| 780723 | N/A | N/A | 136265 | 136284 | TAAATGTGAGGAAATATTTG | 94 | 773 |
| 780724 | N/A | N/A | 137896 | 137915 | CATATGTATAGTCCGTGAAT | 81 | 774 |
| 780725 | N/A | N/A | 138142 | 138161 | TCACTGAGGAATGTGATAAA | 108 | 775 |
| 780726 | N/A | N/A | 138369 | 138388 | TTTATTGACAGCTTACCAGG | 83 | 776 |
| 780727 | N/A | N/A | 138502 | 138521 | AGCAAAAAACAAAGGAGTCA | 94 | 777 |
| 780728 | N/A | N/A | 138562 | 138581 | GAGAACAGTGAGAAGTACAA | 100 | 778 |
| 780729 | N/A | N/A | 138891 | 138910 | TAGAGATCTGAGTCAATTTC | 70 | 779 |
| 780730 | N/A | N/A | 139058 | 139077 | GCTACTGTGAAGGAAAACAT | 66 | 780 |
| 780731 | N/A | N/A | 139370 | 139389 | ATCCAAATGTTAACCACATA | 60 | 781 |
| 780732 | N/A | N/A | 139871 | 139890 | ACAGGAGATACTTGTTCAGA | 62 | 782 |
| 780733 | N/A | N/A | 140263 | 140282 | TAGAAAATAGTTCCAATTAG | 86 | 783 |
| 780734 | N/A | N/A | 140887 | 140906 | CCTTAAAATATTTCCCTTTC | 115 | 784 |
| 780735 | N/A | N/A | 141689 | 141708 | AAAGATAATTCTTTTGGGAA | 129 | 785 |
| 780736 | N/A | N/A | 144735 144754 | 144754 144773 | GTACAAATATGAGTATTTAG | 65 | 786 |

Example 4: Effect of 5-10-5 MOE Gapmers with Mixed Internucleoside Linkages on Human LRRK2 RNA Expression In Vitro, Single Dose Modified oligonucleotides complementary to a human LRRK2 nucleic acid were designed and tested for their effect on LRRK2 RNA in vitro. The modified oligonucleotides were tested in a series of experiments that had similar culture conditions.

Cultured SH-SY5Y cells at a density of 20,000 cells per well were transfected using electroporation with 4,000 nM concentration of modified oligonucleotide or no modified oligonucleotide for untreated controls. After approximately 24 hours, RNA was isolated from the cells and LRRK2 RNA levels were measured by quantitative real-time PCR using human primer probe set RTS3132 as described in Example 2. LRRK2 RNA levels were adjusted according to total RNA content, as measured by RIBOGREEN®. Results are presented in the table below as percent LRRK2 RNA levels relative to untreated control cells. The modified oligonucleotides with percent control values marked with an asterisk (*) target the amplicon region of the primer probe set. Additional assays may be used to measure the potency and efficacy of oligonucleotides targeting the amplicon region.

The modified oligonucleotides in Tables 10-50 are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides. The sugar motif for the gapmers is (from 5' to 3'): eeeeedddddddddddeeeee; wherein 'd' represents a 2'-deoxyribose sugar and 'e' represents a 2'-MOE modified sugar. All cytosine residues throughout each gapmer are 5-methyl cytosines. The internucleoside linkages for each gapmer are mixed phosphodiester and phosphorothioate linkages. The internucleoside linkage motif for the gapmers is (from 5' to 3'): sooosssssssssssooss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Tables 10-50 below is complementary to human LRRK2 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to the sequence of human LRRK2 RNA reduced the amount of human LRRK2 RNA.

TABLE 10

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693426 | 185 | 204 | 3304 | 3323 | TCCTGGACATTGTTCAGCCT | 39 | 55 |
| 780254 | 4111 | 4130 | 86606 | 86625 | GTTTCATTCGGTTATAAGGC | 19 | 235 |
| 780254 | 4111 | 4130 | 86606 | 86625 | GTTTCATTCGGTTATAAGGC | 37 | 235 |
| 802613 | 10 | 29 | 3129 | 3148 | GAGCTCAGCTCACCGCCCGC | 99 | 787 |
| 802614 | 33 | 52 | 3152 | 3171 | GCCGGCCACAGCTCCCCGGG | 138 | 788 |
| 802615 | 80 | 99 | 3199 | 3218 | CCGCCCTCCCAGCATGAACG | 89 | 789 |
| 802616 | 89 | 108 | 3208 | 3227 | TCCAACCCGCCGCCCTCCCA | 122 | 790 |
| 802617 | 109 | 128 | 3228 | 3247 | TAGCCATGGTGGCACCTGCT | 68 | 791 |
| 802618 | 118 | 137 | 3237 | 3256 | AGCTGCCACTAGCCATGGTG | 126 | 792 |
| 802619 | 127 | 146 | 3246 | 3265 | ACCCCTGACAGCTGCCACTA | 83 | 793 |
| 802620 | 136 | 155 | 3255 | 3274 | CCTCTTCGCACCCCTGACAG | 106 | 794 |
| 802621 | 198 | 217 | 3317 | 3336 | TATCTGTTTTCCTTCCTGGA | 67 | 795 |
| 802622 | 199 | 218 | 3318 | 3337 | CTATCTGTTTTCCTTCCTGG | 46 | 796 |
| 802623 | 200 | 219 | 3319 | 3338 | TCTATCTGTTTTCCTTCCTG | 50 | 797 |
| 802624 | 201 | 220 | 3320 | 3339 | TTCTATCTGTTTTCCTTCCT | 42 | 798 |
| 802625 | 202 | 221 | 3321 | 3340 | TTTCTATCTGTTTTCCTTCC | 69 | 799 |
| 802626 | 204 | 223 | 3323 | 3342 | CGTTTCTATCTGTTTTCCTT | 46 | 800 |
| 802627 | 222 | 241 | 3341 | 3360 | CTCCAGGATTTGGACCAGCG | 45 | 801 |
| 802628 | 231 | 250 | 3350 | 3369 | CAGCAGATCCTCCAGGATTT | 91 | 802 |
| 802629 | 240 | 259 | 3359 | 3378 | CGTGAACACCAGCAGATCCT | 68 | 803 |
| 802630 | 280 | 299 | 3671 | 3690 | TATTTTTGCCTTGAAATAAC | 104 | 804 |
| 802631 | 289 | 308 | 3680 | 3699 | GCACATGGATATTTTTGCCT | 38 | 805 |
| 802632 | 298 | 317 | 3689 | 3708 | TCAACAGAGGCACATGGATA | 60 | 806 |

TABLE 10-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802633 | 324 | 343 | 3715 | 3734 | GACTCTCATATAGGAGTCCA | 124 | 807 |
| 802634 | 333 | 352 | 3724 | 3743 | CACACTCGCGACTCTCATAT | 109 | 808 |
| 802635 | 342 | 361 | N/A | N/A | CACCTGCTGCACACTCGCGA | 58 | 809 |
| 802636 | 351 | 370 | N/A | N/A | TGACCAACCCACCTGCTGCA | 101 | 810 |
| 802637 | 371 | 390 | 10395 | 10414 | TCTATTAATTTGCACAGAAG | 104 | 811 |
| 802638 | 380 | 399 | 10404 | 10423 | GGACAGACTTCTATTAATTT | 61 | 812 |
| 802639 | 389 | 408 | 10413 | 10432 | ATTGTACCTGGACAGACTTC | 53 | 813 |
| 802640 | 426 | 445 | 10450 | 10469 | ATCATTTCCAACATCCTGGG | 82 | 814 |
| 802641 | 435 | 454 | 10459 | 10478 | GACTTCCCAATCATTTCCAA | 98 | 815 |
| 802642 | 460 | 479 | N/A | N/A | TAAGAATCAATTGGTGAACA | 62 | 816 |
| 802643 | 469 | 488 | 13735 | 13754 | TTAGCATTTTAAGAATCAAT | 49 | 817 |
| 802644 | 480 | 499 | 13746 | 13765 | ATTATGAACTGTTAGCATTT | 47 | 818 |
| 802645 | 504 | 523 | 13770 | 13789 | AATCACTGACAAGTTTACAC | 74 | 819 |
| 802646 | 513 | 532 | 13779 | 13798 | CTTCAGTCCAATCACTGACA | 54 | 820 |
| 802647 | 522 | 541 | 13788 | 13807 | ATCTAAGGTCTTCAGTCCAA | 80 | 821 |
| 802648 | 534 | 553 | 13800 | 13819 | AGTTAGGAGGAGATCTAAGG | 106 | 822 |
| 802649 | 535 | 554 | 13801 | 13820 | AAGTTAGGAGGAGATCTAAG | 96 | 823 |
| 802650 | 536 | 555 | 13802 | 13821 | GAAGTTAGGAGGAGATCTAA | 87 | 824 |
| 802651 | 537 | 556 | 13803 | 13822 | TGAAGTTAGGAGGAGATCTA | 94 | 825 |
| 802652 | 538 | 557 | 13804 | 13823 | CTGAAGTTAGGAGGAGATCT | 58 | 826 |
| 802653 | 540 | 559 | 13806 | 13825 | ACCTGAAGTTAGGAGGAGAT | 41 | 827 |
| 802654 | 541 | 560 | 13807 | 13826 | TACCTGAAGTTAGGAGGAGA | 53 | 828 |
| 802655 | 542 | 561 | 13808 | 13827 | TTACCTGAAGTTAGGAGGAG | 33 | 829 |
| 802656 | 543 | 562 | N/A | N/A | TTTACCTGAAGTTAGGAGGA | 55 | 830 |
| 802657 | 544 | 563 | N/A | N/A | TTTTACCTGAAGTTAGGAGG | 56 | 831 |
| 802658 | 548 | 567 | N/A | N/A | GTGATTTTACCTGAAGTTAG | 53 | 832 |
| 802659 | 557 | 576 | 16077 | 16096 | ATCAGCAAGGTGATTTTACC | 61 | 833 |
| 802660 | 566 | 585 | 16086 | 16105 | TCATCCAATATCAGCAAGGT | 78 | 834 |
| 802661 | 575 | 594 | 16095 | 16114 | TCACTTTCTTCATCCAATAT | 53 | 835 |
| 802662 | 602 | 621 | 16122 | 16141 | ATGGCATCAAAAATTAACAT | 47 | 836 |
| 802663 | 603 | 622 | 16123 | 16142 | CATGGCATCAAAAATTAACA | 40 | 837 |
| 802664 | 605 | 624 | 16125 | 16144 | TGCATGGCATCAAAAATTAA | 75 | 838 |
| 802665 | 607 | 626 | 16127 | 16146 | AGTGCATGGCATCAAAAATT | 56 | 839 |
| 802666 | 609 | 628 | 16129 | 16148 | TGAGTGCATGGCATCAAAAA | 68 | 840 |
| 802667 | 610 | 629 | 16130 | 16149 | ATGAGTGCATGGCATCAAAA | 62 | 841 |

TABLE 10-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802668 | 612 | 631 | 16132 | 16151 | AAATGAGTGCATGGCATCAA | 54 | 842 |
| 802669 | 613 | 632 | 16133 | 16152 | GAAATGAGTGCATGGCATCA | 49 | 843 |
| 802670 | 620 | 639 | 16140 | 16159 | TTGGCTGGAAATGAGTGCAT | 42 | 844 |
| 802671 | 638 | 657 | 16158 | 16177 | AGTTTCTGGACTTCATCATT | 95 | 845 |
| 802672 | 647 | 666 | 16167 | 16186 | TTGCATCCAAGTTTCTGGAC | 70 | 846 |
| 802673 | 656 | 675 | 16176 | 16195 | TGTAAAGCTTTGCATCCAAG | 73 | 847 |
| 802674 | 682 | 701 | N/A | N/A | CCTCTGAGACTCTCTCAAAC | 41 | 848 |
| 802675 | 691 | 710 | 18590 | 18609 | TCAGTTGCTCCTCTGAGACT | 51 | 849 |
| 802676 | 700 | 719 | 18599 | 18618 | CAAATTCAGTCAGTTGCTCC | 69 | 850 |
| 802677 | 726 | 745 | 18625 | 18644 | CAATATCATATAATCTTTGT | 101 | 851 |
| 802678 | 735 | 754 | 18634 | 18653 | CGCACTTAACAATATCATAT | 34 | 852 |
| 802679 | 744 | 763 | 18643 | 18662 | ATTTGTTAACGCACTTAACA | 63 | 853 |
| 802680 | 753 | 772 | 18652 | 18671 | ATCTTTAAAATTTGTTAACG | 136 | 854 |
| 802681 | 773 | 792 | 18672 | 18691 | TGAAGCACAATTTCCTCTTC | 51 | 855 |
| 802682 | 782 | 801 | 18681 | 18700 | TGCAGCACATGAAGCACAAT | 67 | 856 |
| 802683 | 791 | 810 | 18690 | 18709 | TGTAAACAATGCAGCACATG | 77 | 857 |
| 802684 | 817 | 836 | N/A | N/A | CATTATTGCAAGGAATCGCT | 58 | 858 |
| 802685 | 826 | 845 | N/A | N/A | GGACTTCCACATTATTGCAA | 32 | 859 |
| 802686 | 835 | 854 | 21666 | 21685 | CACTCATGAGGACTTCCACA | 34 | 860 |
| 802687 | 861 | 880 | 21692 | 21711 | CACAATATTATAACACCTGA | 50 | 861 |
| 802688 | 879 | 898 | 21710 | 21729 | TGCTTTCATAGCTTCCACCA | 32 | 862 |

TABLE 11

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 42 | 235 |
| 780254 | 4111 | 4130 | 86606 | 86625 | GTTTCATTCGGTTATAAGGC | 17 | 235 |
| 802689 | 880 | 899 | 21711 | 21730 | ATGCTTTCATAGCTTCCACC | 24 | 863 |
| 802690 | 882 | 901 | 21713 | 21732 | GAATGCTTTCATAGCTTCCA | 36 | 864 |
| 802691 | 884 | 903 | 21715 | 21734 | GGGAATGCTTTCATAGCTT | 30 | 865 |
| 802692 | 886 | 905 | 21717 | 21736 | TAGGGAATGCTTTCATAGCT | 36 | 866 |
| 802693 | 887 | 906 | 21718 | 21737 | ATAGGGAATGCTTTCATAGC | 44 | 867 |
| 802694 | 889 | 908 | 21720 | 21739 | TCATAGGGAATGCTTTCATA | 53 | 868 |

TABLE 11-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802695 | 890 | 909 | 21721 | 21740 | CTCATAGGGAATGCTTTCAT | 44 | 869 |
| 802696 | 891 | 910 | 21722 | 21741 | ACTCATAGGGAATGCTTTCA | 25 | 870 |
| 802697 | 892 | 911 | 21723 | 21742 | CACTCATAGGGAATGCTTTC | 48 | 871 |
| 802698 | 893 | 912 | 21724 | 21743 | TCACTCATAGGGAATGCTTT | 29 | 872 |
| 802699 | 894 | 913 | 21725 | 21744 | TTCACTCATAGGGAATGCTT | 41 | 873 |
| 802700 | 895 | 914 | 21726 | 21745 | TTTCACTCATAGGGAATGCT | 19 | 874 |
| 802701 | 897 | 916 | 21728 | 21747 | TCTTTCACTCATAGGGAATG | 27 | 875 |
| 802702 | 898 | 917 | 21729 | 21748 | TTCTTTCACTCATAGGGAAT | 40 | 876 |
| 802703 | 899 | 918 | 21730 | 21749 | ATTCTTTCACTCATAGGGAA | 35 | 877 |
| 802704 | 900 | 919 | 21731 | 21750 | AATTCTTTCACTCATAGGGA | 40 | 878 |
| 802705 | 901 | 920 | 21732 | 21751 | GAATTCTTTCACTCATAGGG | 30 | 879 |
| 802706 | 905 | 924 | 21736 | 21755 | TCTTGAATTCTTTCACTCAT | 43 | 880 |
| 802707 | 915 | 934 | 21746 | 21765 | GCAACTCACTTCTTGAATTC | 53 | 881 |
| 802708 | 924 | 943 | 21755 | 21774 | GAGCAAACAGCAACTCACTT | 71 | 882 |
| 802709 | 949 | 968 | N/A | N/A | AAAAATTACCTAATGTAAGC | 112 | 883 |
| 802710 | 958 | 977 | 27933 | 27952 | GGATATTGAAAAAATTACCT | 55 | 884 |
| 802711 | 967 | 986 | 27942 | 27961 | TTAATACCAGGATATTGAAA | 88 | 885 |
| 802712 | 989 | 1008 | 27964 | 27983 | ACCACAAACTCATGGACTTC | 42 | 886 |
| 802713 | 990 | 1009 | 27965 | 27984 | CACCACAAACTCATGGACTT | 34 | 887 |
| 802714 | 991 | 1010 | 27966 | 27985 | TCACCACAAACTCATGGACT | 45 | 888 |
| 802715 | 992 | 1011 | 27967 | 27986 | TTCACCACAAACTCATGGAC | 61 | 889 |
| 802716 | 993 | 1012 | 27968 | 27987 | TTTCACCACAAACTCATGGA | 45 | 890 |
| 802717 | 998 | 1017 | 27973 | 27992 | ACAGCTTTCACCACAAACTC | 35 | 891 |
| 802718 | 1007 | 1026 | 27982 | 28001 | TACTGCTGCACAGCTTTCAC | 40 | 892 |
| 802719 | 1016 | 1035 | 27991 | 28010 | TTCTCTGGGTACTGCTGCAC | 47 | 893 |
| 802720 | 1055 | 1074 | 28030 | 28049 | AGGGCCAAACAGCTGAGCGC | 70 | 894 |
| 802721 | 1064 | 1083 | N/A | N/A | TCAGTGAGGAGGGCCAAACA | 83 | 895 |
| 802722 | 1090 | 1109 | 29351 | 29370 | CTAAATCTTGATTTAAGAAA | 134 | 896 |
| 802723 | 1099 | 1118 | 29360 | 29379 | TCTTTTCCTCTAAATCTTGA | 55 | 897 |
| 802724 | 1111 | 1130 | 29372 | 29391 | CTTGATTCTCATTCTTTTCC | 47 | 898 |
| 802725 | 1132 | 1151 | 29393 | 29412 | CTTCCCCCTCATCATCATTC | 58 | 899 |
| 802726 | 1141 | 1160 | 29402 | 29421 | ATTTATCTTCTTCCCCCTCA | 43 | 900 |
| 802727 | 1150 | 1169 | 29411 | 29430 | GCCAAAACAATTTATCTTCT | 44 | 901 |
| 802728 | 1176 | 1195 | 29437 | 29456 | CGTTAATGCTTTGTAACAGG | 26 | 902 |
| 802729 | 1194 | 1213 | 29455 | 29474 | CTTGTTCTTTCTATGCCACG | 64 | 903 |

TABLE 11-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802730 | 1225 | 1244 | 29576 | 29595 | TTAGTGCCCAGCATGCGGCC | 37 | 904 |
| 802731 | 1234 | 1253 | 29585 | 29604 | GGAGATTATTTAGTGCCCAG | 20 | 905 |
| 802732 | 1243 | 1262 | 29594 | 29613 | GGTACATAAGGAGATTATTT | 30 | 906 |
| 802733 | 1269 | 1288 | 29620 | 29639 | TCCAATCTTCTCATGTAAAC | 99 | 907 |
| 802734 | 1278 | 1297 | 29629 | 29648 | ATCTTCATCTCCAATCTTCT | 93 | 908 |
| 802735 | 1287 | 1306 | N/A | N/A | GAAATGGCCATCTTCATCTC | 110 | 909 |
| 802736 | 1313 | 1332 | 31029 | 31048 | GAGAGCATCACTTCCCTATG | 47 | 910 |
| 802737 | 1322 | 1341 | 31038 | 31057 | ATCAGCATGGAGAGCATCAC | 48 | 911 |
| 802738 | 1331 | 1350 | 31047 | 31066 | GAAGAATGCATCAGCATGGA | 58 | 912 |
| 802739 | 1357 | 1376 | 31073 | 31092 | CAGATGCCTGGAAAACTTCC | 51 | 913 |
| 802740 | 1366 | 1385 | 31082 | 31101 | ATGCATTCGCAGATGCCTGG | 43 | 914 |
| 802741 | 1375 | 1394 | 31091 | 31110 | GAGTTGACAATGCATTCGCA | 59 | 915 |
| 802742 | 1385 | 1404 | 31101 | 31120 | TGTTCTAAGAGAGTTGACAA | 85 | 916 |
| 802743 | 1426 | 1445 | 35373 | 35392 | GTATTCCTTTTGATAACAGT | 24 | 917 |
| 802744 | 1435 | 1454 | 35382 | 35401 | CATTCAGGTGTATTCCTTTT | 27 | 918 |
| 802745 | 1444 | 1463 | 35391 | 35410 | ACTCCAAAACATTCAGGTGT | 40 | 919 |
| 802746 | 1470 | 1489 | 35417 | 35436 | AGGAGAATGTATATGCTTCT | 18 | 920 |
| 802747 | 1479 | 1498 | 35426 | 35445 | AGCCACTTCAGGAGAATGTA | 27 | 921 |
| 802748 | 1488 | 1507 | 35435 | 35454 | GCCACTTTCAGCCACTTCAG | 21 | 922 |
| 802749 | 1514 | 1533 | 35461 | 35480 | TCAAAAAGATGATTTAGCAT | 113 | 923 |
| 802750 | 1523 | 1542 | N/A | N/A | TTGCTTCCTTCAAAAAGATG | 78 | 924 |
| 802751 | 1533 | 1552 | N/A | N/A | CAGGGAAGTGTTGCTTCCTT | 53 | 925 |
| 802752 | 1574 | 1593 | 37623 | 37642 | ATAACTGTTAGTATTTTGGG | 34 | 926 |
| 802753 | 1607 | 1626 | 37656 | 37675 | AGCTGCACTGGTAATGATGT | 57 | 927 |
| 802754 | 1631 | 1650 | 37680 | 37699 | TGTAAAATAGCTCGAAGCGC | 90 | 928 |
| 802755 | 1654 | 1673 | N/A | N/A | CTGGCATGCCAGGCACTATA | 62 | 929 |
| 802756 | 1663 | 1682 | N/A | N/A | TGGATTCTTCTGGCATGCCA | 40 | 930 |
| 802757 | 1672 | 1691 | 41905 | 41924 | TATCCTCCCTGGATTCTTCT | 69 | 931 |
| 802758 | 1699 | 1718 | 41932 | 41951 | CCATATTTAGCTTATGATGA | 20 | 932 |
| 802759 | 1708 | 1727 | 41941 | 41960 | GTTTTTTAACCATATTTAGC | 38 | 933 |
| 802760 | 1717 | 1736 | 41950 | 41969 | TGAAACACTGTTTTTTAACC | 48 | 934 |
| 802761 | 1743 | 1762 | 41976 | 41995 | TAGGACCAGTTTGTGAATAT | 72 | 935 |
| 802762 | 1752 | 1771 | 41985 | 42004 | CAAAGCTGCTAGGACCAGTT | 69 | 936 |
| 802763 | 1761 | 1780 | N/A | N/A | GAACCTGTTCAAAGCTGCTA | 47 | 937 |

TABLE 11-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802764 | 1770 | 1789 | N/A | N/A | ATTTCCAATGAACCTGTTCA | 71 | 938 |
| 802765 | 1784 | 1803 | 52698 | 52717 | TTCTGAATCCCAGGATTTCC | 38 | 939 |

TABLE 12

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 42 | 235 |
| 780254 | 4111 | 4130 | 86606 | 86625 | GTTTCATTCGGTTATAAGGC | 50 | 235 |
| 802766 | 1785 | 1804 | 52699 | 52718 | TTTCTGAATCCCAGGATTTC | 140 | 940 |
| 802767 | 1787 | 1806 | 52701 | 52720 | CATTTCTGAATCCCAGGATT | 97 | 941 |
| 802768 | 1788 | 1807 | 52702 | 52721 | ACATTTCTGAATCCCAGGAT | 60 | 942 |
| 802769 | 1790 | 1809 | 52704 | 52723 | CCACATTTCTGAATCCCAGG | 41 | 943 |
| 802770 | 1792 | 1811 | 52706 | 52725 | ATCCACATTTCTGAATCCCA | 57 | 944 |
| 802771 | 1794 | 1813 | 52708 | 52727 | TAATCCACATTTCTGAATCC | 119 | 945 |
| 802772 | 1806 | 1825 | 52720 | 52739 | AGAAATTACTTTTAATCCAC | 97 | 946 |
| 802773 | 1815 | 1834 | 52729 | 52748 | TACAATAGAAGAAATTACTT | 176 | 947 |
| 802774 | 1835 | 1854 | 52749 | 52768 | TCTAATGCATCAGGAAAATG | 145 | 948 |
| 802775 | 1844 | 1863 | 52758 | 52777 | GATAACATCTCTAATGCATC | 56 | 949 |
| 802776 | 1853 | 1872 | 52767 | 52786 | CCTTCCAGGGATAACATCTC | 125 | 950 |
| 802777 | 1862 | 1881 | 52776 | 52795 | TCCATAGCACCTTCCAGGGA | 73 | 951 |
| 802778 | 1868 | 1887 | 52782 | 52801 | ACTGAATCCATAGCACCTTC | 52 | 952 |
| 802779 | 1869 | 1888 | 52783 | 52802 | CACTGAATCCATAGCACCTT | 63 | 953 |
| 802780 | 1870 | 1889 | 52784 | 52803 | GCACTGAATCCATAGCACCT | 44 | 954 |
| 802781 | 1871 | 1890 | 52785 | 52804 | AGCACTGAATCCATAGCACC | 65 | 955 |
| 802782 | 1872 | 1891 | 52786 | 52805 | AAGCACTGAATCCATAGCAC | 70 | 956 |
| 802783 | 1874 | 1893 | 52788 | 52807 | TGAAGCACTGAATCCATAGC | 100 | 957 |
| 802784 | 1875 | 1894 | 52789 | 52808 | GTGAAGCACTGAATCCATAG | 53 | 958 |
| 802785 | 1876 | 1895 | 52790 | 52809 | TGTGAAGCACTGAATCCATA | 107 | 959 |
| 802786 | 1877 | 1896 | 52791 | 52810 | GTGTGAAGCACTGAATCCAT | 62 | 960 |
| 802787 | 1878 | 1897 | 52792 | 52811 | TGTGTGAAGCACTGAATCCA | 73 | 961 |
| 802788 | 1882 | 1901 | 52796 | 52815 | GCAGTGTGTGAAGCACTGAA | 100 | 962 |
| 802789 | 1891 | 1910 | 52805 | 52824 | GATACATCTGCAGTGTGTGA | 116 | 963 |

TABLE 12-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802790 | 1900 | 1919 | 52814 | 52833 | GGTCATCTGGATACATCTGC | 77 | 964 |
| 802791 | 1909 | 1928 | N/A | N/A | GAATTTCTTGGTCATCTGGA | 106 | 965 |
| 802792 | 1928 | 1947 | 52968 | 52987 | AGACTTAAACCCAGACACTG | 78 | 966 |
| 802793 | 1937 | 1956 | 52977 | 52996 | TATCCTATAAGACTTAAACC | 157 | 967 |
| 802794 | 1946 | 1965 | 52986 | 53005 | GTAATCAAGTATCCTATAAG | 105 | 968 |
| 802795 | 1972 | 1991 | 53012 | 53031 | CAGTTCCTATGAACACATTC | 76 | 969 |
| 802796 | 1981 | 2000 | 53021 | 53040 | GCAGATGTCCAGTTCCTATG | 79 | 970 |
| 802797 | 1990 | 2009 | 53030 | 53049 | TTTTTGCCAGCAGATGTCCA | 117 | 971 |
| 802798 | 1999 | 2018 | 53039 | 53058 | AAACCAGAATTTTTGCCAGC | 81 | 972 |
| 802799 | 2018 | 2037 | 53058 | 53077 | TTAAATCGGTATAAGCTGGA | 112 | 973 |
| 802800 | 2027 | 2046 | 53067 | 53086 | GCAACATCCTTAAATCGGTA | 78 | 974 |
| 802801 | 2036 | 2055 | 53076 | 53095 | TGTATTTCAGCAACATCCTT | 145 | 975 |
| 802802 | 2062 | 2081 | N/A | N/A | CTAAGATTGTCTGAAATCCT | 84 | 976 |
| 802803 | 2071 | 2090 | 56005 | 56024 | TGAGGATTGCTAAGATTGTC | 84 | 977 |
| 802804 | 2080 | 2099 | 56014 | 56033 | CTGACAATTTGAGGATTGCT | 58 | 978 |
| 802805 | 2106 | 2125 | 56040 | 56059 | ATGCACCAGCAGCTTAGAAA | 71 | 979 |
| 802806 | 2115 | 2134 | 56049 | 56068 | AAATGAATGATGCACCAGCA | 82 | 980 |
| 802807 | 2124 | 2143 | 56058 | 56077 | TACTAAGTCAAATGAATGAT | 109 | 981 |
| 802808 | 2151 | 2170 | 56085 | 56104 | GATATTGGAAGACATTTGAT | 143 | 982 |
| 802809 | 2160 | 2179 | 56094 | 56113 | TTGTTCCATGATATTGGAAG | 128 | 983 |
| 802810 | 2180 | 2199 | N/A | N/A | TTTAGAAACTGTTGATCCTT | 113 | 984 |
| 802811 | 2181 | 2200 | N/A | N/A | GTTTAGAAACTGTTGATCCT | 128 | 985 |
| 802812 | 2182 | 2201 | N/A | N/A | GGTTTAGAAACTGTTGATCC | 93 | 986 |
| 802813 | 2183 | 2202 | N/A | N/A | AGGTTTAGAAACTGTTGATC | 115 | 987 |
| 802814 | 2184 | 2203 | N/A | N/A | GAGGTTTAGAAACTGTTGAT | 118 | 988 |
| 802815 | 2186 | 2205 | N/A | N/A | CAGAGGTTTAGAAACTGTTG | 63 | 989 |
| 802816 | 2187 | 2206 | N/A | N/A | ACAGAGGTTTAGAAACTGTT | 84 | 990 |
| 802817 | 2188 | 2207 | N/A | N/A | AACAGAGGTTTAGAAACTGT | 119 | 991 |
| 802818 | 2189 | 2208 | N/A | N/A | CAACAGAGGTTTAGAAACTG | 99 | 992 |
| 802819 | 2190 | 2209 | 56198 | 56217 | GCAACAGAGGTTTAGAAACT | 94 | 993 |
| 802820 | 2194 | 2213 | 56202 | 56221 | ACTTGCAACAGAGGTTTAGA | 109 | 994 |
| 802821 | 2203 | 2222 | 56211 | 56230 | TTGCAAAACACTTGCAACAG | 120 | 995 |
| 802822 | 2212 | 2231 | 56220 | 56239 | TAGCTACTTTTGCAAAACAC | 88 | 996 |
| 802823 | 2238 | 2257 | 56246 | 56265 | CATCACATTTTTAAGTAAT | 100 | 997 |
| 802824 | 2247 | 2266 | 56255 | 56274 | TCTCTCTAGCATCACATTTT | 80 | 998 |
| 802825 | 2256 | 2275 | 56264 | 56283 | ATCACACGCTCTCTCTAGCA | 57 | 999 |

TABLE 12-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802826 | 2282 | 2301 | 56290 | 56309 | CATTCAACCATGATGCTGTT | 79 | 72 |
| 802827 | 2291 | 2310 | 56299 | 56318 | AGAAGCAAGCATTCAACCAT | 103 | 1000 |
| 802828 | 2300 | 2319 | 56308 | 56327 | GCTCCCAATAGAAGCAAGCA | 108 | 1001 |
| 802829 | 2312 | 2331 | 56320 | 56339 | TGATTGGCATCTGCTCCCAA | 96 | 1002 |
| 802830 | 2313 | 2332 | 56321 | 56340 | TTGATTGGCATCTGCTCCCA | 67 | 1003 |
| 802831 | 2314 | 2333 | 56322 | 56341 | CTTGATTGGCATCTGCTCCC | 87 | 1004 |
| 802832 | 2315 | 2334 | 56323 | 56342 | GCTTGATTGGCATCTGCTCC | 54 | 1005 |
| 802833 | 2316 | 2335 | 56324 | 56343 | TGCTTGATTGGCATCTGCTC | 83 | 1006 |
| 802834 | 2318 | 2337 | 56326 | 56345 | TTTGCTTGATTGGCATCTGC | 82 | 125 |
| 802835 | 2319 | 2338 | 56327 | 56346 | CTTTGCTTGATTGGCATCTG | 80 | 1007 |
| 802836 | 2320 | 2339 | 56328 | 56347 | CCTTTGCTTGATTGGCATCT | 70 | 1008 |
| 802837 | 2321 | 2340 | 56329 | 56348 | TCCTTTGCTTGATTGGCATC | 94 | 1009 |
| 802838 | 2322 | 2341 | 56330 | 56349 | CTCCTTTGCTTGATTGGCAT | 75 | 1010 |
| 802839 | 2326 | 2345 | 56334 | 56353 | ATCCCTCCTTTGCTTGATTG | 124 | 1011 |
| 802840 | 2335 | 2354 | 56343 | 56362 | TTAAAGAAGATCCCTCCTTT | 186 | 1012 |
| 802841 | 2344 | 2363 | 56352 | 56371 | CCTGACAAATTAAAGAAGAT | 148 | 1013 |
| 802842 | 2357 | 2376 | N/A | N/A | TCTTTCTCACATACCTGACA | 69 | 1014 |

TABLE 13

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693433 | 2380 | 2399 | 62001 | 62020 | GTTCCACCAATTTGGGACTG | 41 | 126 |
| 780254 | 4111 | 4130 | 86606 | 86625 | GTTTCATTCGGTTATAAGGC | 30 | 235 |
| 780254 | 4111 | 4130 | 86606 | 86625 | GTTTCATTCGGTTATAAGGC | 22 | 235 |
| 802843 | 2358 | 2377 | N/A | N/A | CTCTTTCTCACATACCTGAC | 74 | 1015 |
| 802844 | 2360 | 2379 | N/A | N/A | CTCTCTTTCTCACATACCTG | 53 | 1016 |
| 802845 | 2365 | 2384 | 61986 | 62005 | GACTGCTCTCTTTCTCACAT | 34 | 1017 |
| 802846 | 2367 | 2386 | 61988 | 62007 | GGGACTGCTCTCTTTCTCAC | 39 | 1018 |
| 802847 | 2369 | 2388 | 61990 | 62009 | TTGGGACTGCTCTCTTTCTC | 53 | 1019 |
| 802848 | 2370 | 2389 | 61991 | 62010 | TTTGGGACTGCTCTCTTTCT | 59 | 1020 |
| 802849 | 2372 | 2391 | 61993 | 62012 | AATTGGGACTGCTCTCTTT | 99 | 1021 |
| 802850 | 2373 | 2392 | 61994 | 62013 | CAATTGGGACTGCTCTCTT | 83 | 1022 |

TABLE 13-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802851 | 2389 | 2408 | 62010 | 62029 | TCAGTAAGAGTTCCACCAAT | 65 | 1023 |
| 802852 | 2415 | 2434 | 62036 | 62055 | TACATCTTGTTCACGAGATC | 92 | 1024 |
| 802853 | 2460 | 2479 | 62081 | 62100 | GATCTGGCTGTCACCTTTCC | 65 | 1025 |
| 802854 | 2469 | 2488 | 62090 | 62109 | CAAGCTGATGATCTGGCTGT | 98 | 1026 |
| 802855 | 2478 | 2497 | 62099 | 62118 | CCTTAAGAGCAAGCTGATGA | 58 | 1027 |
| 802856 | 2487 | 2506 | 62108 | 62127 | GGCCAGCCTCCTTAAGAGCA | 74 | 1028 |
| 802857 | 2508 | 2527 | 62129 | 62148 | GCTATTGTTGGCCACATCCA | 44 | 1029 |
| 802858 | 2517 | 2536 | 62138 | 62157 | AAGGCAAATGCTATTGTTGG | 90 | 1030 |
| 802859 | 2526 | 2545 | 62147 | 62166 | AAATCCTCCAAGGCAAATGC | 92 | 1031 |
| 802860 | 2552 | 2571 | 62173 | 62192 | CAAGAAGGTTCAACTTTTCC | 87 | 1032 |
| 802861 | 2596 | 2615 | 62217 | 62236 | GTTTCCTTAAATTAGAAGTC | 169 | 1033 |
| 802862 | 2606 | 2625 | N/A | N/A | ATATTTGTTTGTTTCCTTAA | 81 | 1034 |
| 802863 | 2615 | 2634 | N/A | N/A | GTAGATGCTATATTTGTTTG | 82 | 1035 |
| 802864 | 2641 | 2660 | 65479 | 65498 | GATATCTGATCACCATTCTT | 78 | 1036 |
| 802865 | 2650 | 2669 | 65488 | 65507 | TTTTCATCTGATATCTGATC | 121 | 1037 |
| 802866 | 2659 | 2678 | 65497 | 65516 | CCACAGCACTTTTCATCTGA | 116 | 1038 |
| 802867 | 2668 | 2687 | 65506 | 65525 | TTCCTTCTTCCACAGCACTT | 115 | 1039 |
| 802868 | 2687 | 2706 | 65525 | 65544 | CCATCGCTGCCTGAGGCTGT | 69 | 1040 |
| 802869 | 2696 | 2715 | 65534 | 65553 | GAAAAATTTCCATCGCTGCC | 149 | 1041 |
| 802870 | 2705 | 2724 | 65543 | 65562 | ACATCTTCAGAAAAATTTCC | 86 | 1042 |
| 802871 | 2731 | 2750 | 65569 | 65588 | AGGTCCATTCATCAAATTTA | 77 | 1043 |
| 802872 | 2740 | 2759 | 65578 | 65597 | CAGGAATAAAGGTCCATTCA | 68 | 1044 |
| 802873 | 2749 | 2768 | 65587 | 65606 | TAGAAGAGTCAGGAATAAAG | 119 | 1045 |
| 802874 | 2761 | 2780 | 65599 | 65618 | ACACACTGTCCATAGAAGAG | 53 | 1046 |
| 802875 | 2763 | 2782 | 65601 | 65620 | AAACACACTGTCCATAGAAG | 102 | 1047 |
| 802876 | 2765 | 2784 | 65603 | 65622 | GCAAACACACTGTCCATAGA | 43 | 1048 |
| 802877 | 2767 | 2786 | 65605 | 65624 | GAGCAAACACACTGTCCATA | 42 | 1049 |
| 802878 | 2768 | 2787 | 65606 | 65625 | TGAGCAAACACACTGTCCAT | 70 | 1050 |
| 802879 | 2770 | 2789 | 65608 | 65627 | TTTGAGCAAACACACTGTCC | 124 | 1051 |
| 802880 | 2771 | 2790 | 65609 | 65628 | CTTTGAGCAAACACACTGTC | 141 | 1052 |
| 802881 | 2778 | 2797 | 65616 | 65635 | GTCATCACTTTGAGCAAACA | 90 | 1053 |
| 802882 | 2787 | 2806 | 65625 | 65644 | ACTATCCAGGTCATCACTTT | 121 | 1054 |
| 802883 | 2796 | 2815 | N/A | N/A | ACTTCCTTCACTATCCAGGT | 53 | 1055 |
| 802884 | 2819 | 2838 | 71662 | 71681 | TTTTTCACAAGAAATGAGCC | 96 | 1056 |
| 802885 | 2828 | 2847 | 71671 | 71690 | TTAGATTTCTTTTCACAAG | 116 | 1057 |
| 802886 | 2837 | 2856 | 71680 | 71699 | CTAATTGAATTAGATTTCTT | 106 | 1058 |

TABLE 13-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802887 | 2863 | 2882 | 71706 | 71725 | CGGCATCTCGGTAAAATTCT | 48 | 1059 |
| 802888 | 2872 | 2891 | 71715 | 71734 | GCTGTAATACGGCATCTCGG | 27 | 1060 |
| 802889 | 2907 | 2926 | 71750 | 71769 | GGAATTGGAATGTCTTTGCA | 76 | 1061 |
| 802890 | 2916 | 2935 | N/A | N/A | GGGCCCCAAGGAATTGGAAT | 102 | 1062 |
| 802891 | 2925 | 2944 | N/A | N/A | ATCAAAAATGGGCCCCAAGG | 87 | 1063 |
| 802892 | 2951 | 2970 | 72975 | 72994 | CTTTTTCGCTTCAGTAAATC | 79 | 1064 |
| 802893 | 2962 | 2981 | 72986 | 73005 | ATAATATTTTCTTTTTCGC | 109 | 1065 |
| 802894 | 2971 | 2990 | 72995 | 73014 | CATCTGAAGATAATATTTTT | 141 | 1066 |
| 802895 | 2995 | 3014 | N/A | N/A | GAAGTTTTGATGACCTGAGT | 108 | 1067 |
| 802896 | 3004 | 3023 | 73540 | 73559 | TATGGGATTGAAGTTTTGAT | 56 | 1068 |
| 802897 | 3013 | 3032 | 73549 | 73568 | AATGCCTCATATGGGATTGA | 93 | 1069 |
| 802898 | 3022 | 3041 | 73558 | 73577 | TGCTGTCTGAATGCCTCATA | 60 | 1070 |
| 802899 | 3040 | 3059 | 73576 | 73595 | CAGAAGCCAGAGAAGAAATG | 135 | 1071 |
| 802900 | 3049 | 3068 | 73585 | 73604 | ATTCTCTCTCAGAAGCCAGA | 53 | 1072 |
| 802901 | 3058 | 3077 | 73594 | 73613 | ATGTAATATATTCTCTCTCA | 52 | 1073 |
| 802902 | 3084 | 3103 | 73620 | 73639 | TAGTTCATTTGCTGAAAGGT | 66 | 1074 |
| 802903 | 3093 | 3112 | 73629 | 73648 | AATATCTCTTAGTTCATTTG | 146 | 1075 |
| 802904 | 3102 | 3121 | 73638 | 73657 | TAGGGCATCAATATCTCTTA | 40 | 1076 |
| 802905 | 3111 | 3130 | 73647 | 73666 | TTTCTGGCTTAGGGCATCAA | 133 | 1077 |
| 802906 | 3129 | 3148 | 73665 | 73684 | ATGAACACTTATACAGCATT | 114 | 1078 |
| 802907 | 3138 | 3157 | 73674 | 73693 | ATGCTCCAAATGAACACTTA | 124 | 1079 |
| 802908 | 3147 | 3166 | 73683 | 73702 | CTTTTCAAGATGCTCCAAAT | 170 | 1080 |
| 802909 | 3173 | 3192 | 73709 | 73728 | GTGAGTGCATTCTGGTGAAG | 72 | 1081 |
| 802910 | 3192 | 3211 | 73728 | 73747 | TAGCTGTTGTGGAAAGCTCG | 114 | 1082 |
| 802911 | 3217 | 3236 | N/A | N/A | GTGTCAAACTCTTCAGAGTT | 34 | 1083 |
| 802912 | 3218 | 3237 | 76352 | 76371 | TGTGTCAAACTCTTCAGAGT | 60 | 1084 |
| 802913 | 3219 | 3238 | 76353 | 76372 | ATGTGTCAAACTCTTCAGAG | 63 | 1085 |
| 802914 | 3220 | 3239 | 76354 | 76373 | AATGTGTCAAACTCTTCAGA | 99 | 1086 |
| 802915 | 3226 | 3245 | 76360 | 76379 | AGTCCAAATGTGTCAAACTC | 23 | 1087 |
| 802916 | 3235 | 3254 | 76369 | 76388 | TACTGTGCAAGTCCAAATGT | 119 | 1088 |
| 802917 | 3244 | 3263 | 76378 | 76397 | TAAATTTATTACTGTGCAAG | 55 | 1089 |
| 802918 | 3265 | 3284 | 76399 | 76418 | ACAAATAAGAAGGAAATGAT | 196 | 1090 |

TABLE 14

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 22 | 235 |
| 780254 | 4111 | 4130 | 86606 | 86625 | GTTTCATTCGGTTATAAGGC | 29 | 235 |
| 802919 | 3274 | 3293 | 76408 | 76427 | TCATTTTCAACAAATAAGAA | 110 | 1091 |
| 802920 | 3283 | 3302 | 76417 | 76436 | CAATACAACTCATTTTCAAC | 63 | 1092 |
| 802921 | 3309 | 3328 | 76443 | 76462 | GTCATTTCGAGAGACATCAA | 36 | 1093 |
| 802922 | 3318 | 3337 | 76452 | 76471 | GGGTCCAATGTCATTTCGAG | 38 | 1094 |
| 802923 | 3327 | 3346 | 76461 | 76480 | AACCACTGAGGGTCCAATGT | 51 | 1095 |
| 802924 | 3353 | 3372 | 76487 | 76506 | GTTGGACATTTCACTGTAGG | 20 | 1096 |
| 802925 | 3362 | 3381 | 76496 | 76515 | TGTTTCAGAGTTGGACATTT | 77 | 1097 |
| 802926 | 3371 | 3390 | 76505 | 76524 | AGGTTAAACTGTTTCAGAGT | 36 | 1098 |
| 802927 | 3380 | 3399 | 76514 | 76533 | TTATATGACAGGTTAAACTG | 103 | 1099 |
| 802928 | 3398 | 3417 | 76532 | 76551 | GGTACAAAAGACAGCTGGTT | 34 | 1100 |
| 802929 | 3407 | 3426 | 76541 | 76560 | AGGTTCTCAGGTACAAAAGA | 47 | 1101 |
| 802930 | 3416 | 3435 | 76550 | 76569 | ACATCAGTGAGGTTCTCAGG | 37 | 1102 |
| 802931 | 3442 | 3461 | 76576 | 76595 | AAATGAGCTGCTCCAGTTTC | 75 | 1103 |
| 802932 | 3451 | 3470 | N/A | N/A | TTCCTTCTAAAATGAGCTGC | 53 | 1104 |
| 802933 | 3463 | 3482 | N/A | N/A | CTGATATTTTATTTCCTTCT | 69 | 1105 |
| 802934 | 3472 | 3491 | 77221 | 77240 | AGCATATCCCTGATATTTTA | 29 | 1106 |
| 802935 | 3495 | 3514 | 77244 | 77263 | CAGTTCCTTCAGTCTCAAGG | 32 | 1107 |
| 802936 | 3496 | 3515 | 77245 | 77264 | TCAGTTCCTTCAGTCTCAAG | 49 | 1108 |
| 802937 | 3497 | 3516 | 77246 | 77265 | TTCAGTTCCTTCAGTCTCAA | 80 | 1109 |
| 802938 | 3498 | 3517 | 77247 | 77266 | CTTCAGTTCCTTCAGTCTCA | 37 | 1110 |
| 802939 | 3499 | 3518 | 77248 | 77267 | TCTTCAGTTCCTTCAGTCTC | 56 | 1111 |
| 802940 | 3505 | 3524 | 77254 | 77273 | TTAAAATCTTCAGTTCCTTC | 59 | 1112 |
| 802941 | 3514 | 3533 | 77263 | 77282 | TACTAAGGTTTAAAATCTTC | 105 | 1113 |
| 802942 | 3523 | 3542 | 77272 | 77291 | TGTGGTTCTTACTAAGGTTT | 38 | 1114 |
| 802943 | 3547 | 3566 | 77296 | 77315 | GAAAGTTCTCTGATAGGGAT | 59 | 1115 |
| 802944 | 3556 | 3575 | 77305 | 77324 | AAGCCTCAAGAAAGTTCTCT | 59 | 1116 |
| 802945 | 3565 | 3584 | 77314 | 77333 | CTTTAGGACAAGCCTCAAGA | 65 | 132 |
| 802946 | 3591 | 3610 | 77340 | 77359 | ATTCATTCTGGCACTGAAAC | 136 | 1117 |
| 802947 | 3600 | 3619 | N/A | N/A | AGCAAGAAAATTCATTCTGG | 75 | 1118 |
| 802948 | 3609 | 3628 | N/A | N/A | AGGCATAGCAGCAAGAAAAT | 57 | 1119 |
| 802949 | 3635 | 3654 | 80915 | 80934 | AGGATTGTCATAGAAGGAGG | 19 | 1120 |
| 802950 | 3644 | 3663 | 80924 | 80943 | GATAATTTTAGGATTGTCAT | 58 | 1121 |
| 802951 | 3654 | 3673 | 80934 | 80953 | TTTGTTCTGAGATAATTTTA | 32 | 1122 |
| 802952 | 3679 | 3698 | 80959 | 80978 | AAATTGCTTCTGGAATACAG | 75 | 1123 |

TABLE 14-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802953 | 3688 | 3707 | 80968 | 80987 | GAAGATTTAAAATTGCTTCT | 115 | 1124 |
| 802954 | 3697 | 3716 | N/A | N/A | GCAAGTGTGGAAGATTTAAA | 50 | 1125 |
| 802955 | 3709 | 3728 | N/A | N/A | TATCTAAAGACCGCAAGTGT | 51 | 1126 |
| 802956 | 3710 | 3729 | N/A | N/A | ATATCTAAAGACCGCAAGTG | 62 | 1127 |
| 802957 | 3711 | 3730 | N/A | N/A | CATATCTAAAGACCGCAAGT | 63 | 1128 |
| 802958 | 3712 | 3731 | 82057 | 82076 | TCATATCTAAAGACCGCAAG | 71 | 1129 |
| 802959 | 3713 | 3732 | 82058 | 82077 | CTCATATCTAAAGACCGCAA | 47 | 1130 |
| 802960 | 3715 | 3734 | 82060 | 82079 | TGCTCATATCTAAAGACCGC | 35 | 1131 |
| 802961 | 3716 | 3735 | 82061 | 82080 | CTGCTCATATCTAAAGACCG | 43 | 1132 |
| 802962 | 3717 | 3736 | 82062 | 82081 | GCTGCTCATATCTAAAGACC | 28 | 1133 |
| 802963 | 3718 | 3737 | 82063 | 82082 | TGCTGCTCATATCTAAAGAC | 64 | 1134 |
| 802964 | 3719 | 3738 | 82064 | 82083 | TTGCTGCTCATATCTAAAGA | 79 | 1135 |
| 802965 | 3723 | 3742 | 82068 | 82087 | ATCATTGCTGCTCATATCTA | 82 | 1136 |
| 802966 | 3732 | 3751 | 82077 | 82096 | GTACTGAATATCATTGCTGC | 31 | 1137 |
| 802967 | 3741 | 3760 | 82086 | 82105 | ACCTGGTAGGTACTGAATAT | 50 | 1138 |
| 802968 | 3767 | 3786 | 82112 | 82131 | AAGTTCAAAGATTTCCAGTG | 50 | 1139 |
| 802969 | 3776 | 3795 | 82121 | 82140 | AGTTCCCTTAAGTTCAAAGA | 78 | 1140 |
| 802970 | 3785 | 3804 | 82130 | 82149 | CTAAATAAGAGTTCCCTTAA | 75 | 1141 |
| 802971 | 3811 | 3830 | 82156 | 82175 | AGTCCAAGATGCTGATCTGA | 49 | 1142 |
| 802972 | 3820 | 3839 | 82165 | 82184 | TTTCACTCAAGTCCAAGATG | 52 | 1143 |
| 802973 | 3829 | 3848 | 82174 | 82193 | AATATGCTTTTTCACTCAAG | 64 | 1144 |
| 802974 | 3855 | 3874 | 82200 | 82219 | ATGCAGTTTCTCTACTCTAG | 31 | 1145 |
| 802975 | 3864 | 3883 | 82209 | 82228 | GTGAGAAAGATGCAGTTTCT | 47 | 1146 |
| 802976 | 3873 | 3892 | 82218 | 82237 | CAGTTTATTGTGAGAAAGAT | 89 | 1147 |
| 802977 | 3882 | 3901 | N/A | N/A | AATCTCTTTCAGTTTATTGT | 65 | 1148 |
| 802978 | 3900 | 3919 | 83895 | 83914 | ACAGCCAATCTCAGGAGGAA | 56 | 1149 |
| 802979 | 3909 | 3928 | 83904 | 83923 | ATTTTCAAGACAGCCAATCT | 72 | 1150 |
| 802980 | 3918 | 3937 | 83913 | 83932 | AGATGTCAGATTTTCAAGAC | 141 | 1151 |
| 802981 | 3944 | 3963 | 83939 | 83958 | AGTTCCAAGTTGTAACTGAC | 59 | 57 |
| 802982 | 3953 | 3972 | 83948 | 83967 | AAGGATCTTAGTTCCAAGTT | 89 | 1152 |
| 802983 | 3962 | 3981 | 83957 | 83976 | TCATTGGGAAAGGATCTTAG | 107 | 1153 |
| 802984 | 3988 | 4007 | 83983 | 84002 | CCCATATTTTGCTTAATTTC | 54 | 1154 |
| 802985 | 3997 | 4016 | 83992 | 84011 | AAGGAAGATCCCATATTTTG | 72 | 1155 |
| 802986 | 4006 | 4025 | 84001 | 84020 | GTTCATCCAAAGGAAGATCC | 40 | 1156 |
| 802987 | 4033 | 4052 | 84028 | 84047 | TATGTTTAAAATCAAGTTA | 128 | 1157 |

TABLE 14-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802988 | 4042 | 4061 | 84037 | 84056 | TACATCCTATATGTTTAAAA | 101 | 1158 |
| 802989 | 4060 | 4079 | 84055 | 84074 | TTATGATGTCTTTGGCTTTA | 41 | 1159 |
| 802990 | 4061 | 4080 | 84056 | 84075 | CTTATGATGTCTTTGGCTTT | 53 | 1160 |
| 802991 | 4063 | 4082 | 84058 | 84077 | ACCTTATGATGTCTTTGGCT | 36 | 1161 |
| 802992 | 4065 | 4084 | N/A | N/A | AAACCTTATGATGTCTTTGG | 41 | 1162 |
| 802993 | 4068 | 4087 | N/A | N/A | AAGAAACCTTATGATGTCTT | 80 | 1163 |
| 802994 | 4078 | 4097 | N/A | N/A | ATCGCTGTTGAAGAAACCTT | 38 | 1164 |
| 802995 | 4087 | 4106 | 86582 | 86601 | CCTTTTTTAATCGCTGTTGA | 69 | 1165 |

TABLE 15

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 31 | 235 |
| 780254 | 4111 | 4130 | 86606 | 86625 | GTTTCATTCGGTTATAAGGC | 51 | 235 |
| 802996 | 4096 | 4115 | 86591 | 86610 | AAGGCACAGCCTTTTTTAAT | 88 | 1166 |
| 802997 | 4106 | 4125 | 86601 | 86620 | ATTCGGTTATAAGGCACAGC | 39 | 1167 |
| 802998 | 4107 | 4126 | 86602 | 86621 | CATTCGGTTATAAGGCACAG | 54 | 1168 |
| 802999 | 4108 | 4127 | 86603 | 86622 | TCATTCGGTTATAAGGCACA | 51 | 1169 |
| 803000 | 4109 | 4128 | 86604 | 86623 | TTCATTCGGTTATAAGGCAC | 34 | 1170 |
| 803001 | 4110 | 4129 | 86605 | 86624 | TTTCATTCGGTTATAAGGCA | 47 | 1171 |
| 803002 | 4112 | 4131 | 86607 | 86626 | AGTTTCATTCGGTTATAAGG | 57 | 1172 |
| 803003 | 4113 | 4132 | 86608 | 86627 | AAGTTTCATTCGGTTATAAG | 72 | 1173 |
| 803004 | 4114 | 4133 | 86609 | 86628 | TAAGTTTCATTCGGTTATAA | 89 | 1174 |
| 803005 | 4115 | 4134 | 86610 | 86629 | ATAAGTTTCATTCGGTTATA | 44 | 1175 |
| 803006 | 4116 | 4135 | 86611 | 86630 | CATAAGTTTCATTCGGTTAT | 45 | 1176 |
| 803007 | 4120 | 4139 | 86615 | 86634 | CAATCATAAGTTTCATTCGG | 51 | 1177 |
| 803008 | 4129 | 4148 | 86624 | 86643 | TATTTCCCACAATCATAAGT | 98 | 1178 |
| 803009 | 4138 | 4157 | 86633 | 86652 | CACTCCCAGTATTTCCCACA | 69 | 1179 |
| 803010 | 4164 | 4183 | 86659 | 86678 | TAATTGCTGCAATAAGGTGG | 51 | 1180 |
| 803011 | 4173 | 4192 | 86668 | 86687 | GGTTTTCATTAATTGCTGCA | 40 | 1181 |
| 803012 | 4184 | 4203 | 86679 | 86698 | TCTGATTTCTTGGTTTTCAT | 58 | 1182 |
| 803013 | 4208 | 4227 | 86703 | 86722 | ACTGTGGCACTTTGCATTCC | 80 | 1183 |
| 803014 | 4217 | 4236 | 86712 | 86731 | TCTATGCCAACTGTGGCACT | 79 | 1184 |

TABLE 15-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803015 | 4226 | 4245 | 86721 | 86740 | TCTTTCACATCTATGCCAAC | 79 | 1185 |
| 803016 | 4252 | 4271 | 86747 | 86766 | TTTTGTCTCTTATTTGGATA | 44 | 1186 |
| 803017 | 4267 | 4286 | 86762 | 86781 | CGAGATCTCTCTTTCTTTTG | 56 | 1187 |
| 803018 | 4276 | 4295 | 86771 | 86790 | CATTTAGGACGAGATCTCTC | 92 | 1188 |
| 803019 | 4296 | 4315 | N/A | N/A | ACGACCTGCAAAATCCCACA | 65 | 1189 |
| 803020 | 4305 | 4324 | N/A | N/A | GAATTCCTCACGACCTGCAA | 90 | 83 |
| 803021 | 4314 | 4333 | 87218 | 87237 | AGTACTATAGAATTCCTCAC | 35 | 1190 |
| 803022 | 4359 | 4378 | 87263 | 87282 | ATAGACAGCAAGGTACAATG | 101 | 1191 |
| 803023 | 4368 | 4387 | 87272 | 87291 | GCTGAGGTCATAGACAGCAA | 101 | 1192 |
| 803024 | 4377 | 4396 | 87281 | 87300 | CTGTCCCTTGCTGAGGTCAT | 89 | 1193 |
| 803025 | 4403 | 4422 | 87307 | 87326 | CAAGGCTTCATGGCATCAAC | 85 | 1194 |
| 803026 | 4412 | 4431 | 87316 | 87335 | TTGAAGAGCCAAGGCTTCAT | 96 | 1195 |
| 803027 | 4421 | 4440 | N/A | N/A | GCCTTTATATTGAAGAGCCA | 62 | 1196 |
| 803028 | 4456 | 4475 | 88557 | 88576 | TGCCAACGAGAATCACAGGG | 45 | 1197 |
| 803029 | 4465 | 4484 | 88566 | 88585 | CCAAATGTGTGCCAACGAGA | 70 | 1198 |
| 803030 | 4474 | 4493 | 88575 | 88594 | CAGAAACATCCAAATGTGTG | 69 | 1199 |
| 803031 | 4505 | 4524 | 88606 | 88625 | TTACTCATGCAGGCTTTGCG | 44 | 1200 |
| 803032 | 4514 | 4533 | 88615 | 88634 | TTGGTGATTTTACTCATGCA | 43 | 1201 |
| 803033 | 4536 | 4555 | 88637 | 88656 | CCCTCGCTTATTCAGGAGTT | 98 | 1202 |
| 803034 | 4545 | 4564 | 88646 | 88665 | GGCAGGGAACCCTCGCTTAT | 61 | 1203 |
| 803035 | 4580 | 4599 | 88681 | 88700 | TCCTCGGTGGCATTCACAAA | 60 | 42 |
| 803036 | 4589 | 4608 | 88690 | 88709 | GCATCAGATTCCTCGGTGGC | 39 | 1204 |
| 803037 | 4598 | 4617 | 88699 | 88718 | TTTGCCAAAGCATCAGATTC | 67 | 1205 |
| 803038 | 4639 | 4658 | N/A | N/A | TCTTGAAATTAAGGCTCTCG | 91 | 1206 |
| 803039 | 4648 | 4667 | N/A | N/A | GATCTCGGATCTTGAAATTA | 125 | 1207 |
| 803040 | 4668 | 4687 | 92091 | 92110 | CAGCTGTCCAACAACAAGCT | 81 | 1208 |
| 803041 | 4677 | 4696 | 92100 | 92119 | GTCTGGAATCAGCTGTCCAA | 55 | 1209 |
| 803042 | 4686 | 4705 | 92109 | 92128 | TACATAGCAGTCTGGAATCA | 75 | 1210 |
| 803043 | 4712 | 4731 | 92135 | 92154 | TCCGATAAAATGATTTTTTC | 60 | 1211 |
| 803044 | 4721 | 4740 | 92144 | 92163 | TTTTTACGCTCCGATAAAAT | 132 | 1212 |
| 803045 | 4730 | 4749 | 92153 | 92172 | ATTGGCACATTTTTACGCTC | 24 | 1213 |
| 803046 | 4756 | 4775 | 92179 | 92198 | GTTTCCGGTCAATTACGGGA | 21 | 1214 |
| 803047 | 4775 | 4794 | 92198 | 92217 | CTCACTAGTTGTAATAATCG | 63 | 1215 |
| 803048 | 4800 | 4819 | 92223 | 92242 | TTCATCTAACTGCAGCTGAT | 59 | 1216 |
| 803049 | 4810 | 4829 | 92233 | 92252 | GAAGCTCATTTTCATCTAAC | 49 | 1217 |

TABLE 15-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803050 | 4844 | 4863 | N/A | N/A | ACTCCTGATTCATTTAGAAA | 88 | 1218 |
| 803051 | 4853 | 4872 | N/A | N/A | TGAAGAAGGACTCCTGATTC | 99 | 1219 |
| 803052 | 4862 | 4881 | 93323 | 93342 | TCTTGAAAATGAAGAAGGAC | 100 | 1220 |
| 803053 | 4871 | 4890 | 93332 | 93351 | AGTGCTGGGTCTTGAAAATG | 55 | 1221 |
| 803054 | 4892 | 4911 | 93353 | 93372 | AAGTACAAGTCACTTAACTG | 38 | 1222 |
| 803055 | 4938 | 4957 | N/A | N/A | TGTCAAAATCTGTGCCATGA | 70 | 1223 |
| 803056 | 4947 | 4966 | 98095 | 98114 | CACTTTCACTGTCAAAATCT | 76 | 1224 |
| 803057 | 4956 | 4975 | 98104 | 98123 | ACAACCTTCCACTTTCACTG | 65 | 1225 |
| 803058 | 4982 | 5001 | 98130 | 98149 | GAAATAATGCCCTTAGGGTG | 98 | 1226 |
| 803059 | 4991 | 5010 | 98139 | 98158 | TCTCTACGCGAAATAATGCC | 58 | 1227 |
| 803060 | 5000 | 5019 | 98148 | 98167 | TTTTCCACATCTCTACGCGA | 49 | 1228 |
| 803061 | 5009 | 5028 | 98157 | 98176 | GAAAGAAATTTTTCCACATC | 65 | 1229 |
| 803062 | 5028 | 5047 | 98176 | 98195 | TGGAAATTTCCTTTTTTTTG | 81 | 1230 |
| 803063 | 5038 | 5057 | 98186 | 98205 | TGTAGTTCTTTGGAAATTTC | 45 | 1231 |
| 803064 | 5047 | 5066 | 98195 | 98214 | ACTGTGACATGTAGTTCTTT | 29 | 1232 |
| 803065 | 5072 | 5091 | 98220 | 98239 | TGGAATTTTTCTAGGAGCTT | 23 | 1233 |
| 803066 | 5082 | 5101 | 98230 | 98249 | CAAAGCAATCTGGAATTTTT | 104 | 1234 |
| 803067 | 5091 | 5110 | 98239 | 98258 | TCCTATTGGCAAAGCAATCT | 79 | 1235 |
| 803068 | 5100 | 5119 | 98248 | 98267 | ATATTCTTCTCCTATTGGCA | 84 | 1236 |
| 803069 | 5118 | 5137 | N/A | N/A | ACTGCTTGGAACCAGCAAAT | 72 | 1237 |
| 803070 | 5127 | 5146 | N/A | N/A | GTCAGACAAACTGCTTGGAA | 84 | 1238 |
| 803071 | 5136 | 5155 | 99142 | 99161 | AGGCCTGTGGTCAGACAAAC | 87 | 1239 |
| 803072 | 5145 | 5164 | 99151 | 99170 | CTCTATCACAGGCCTGTGGT | 73 | 1240 |

TABLE 16

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 11 | 235 |
| 780254 | 4111 | 4130 | 86606 | 86625 | GTTTCATTCGGTTATAAGGC | 26 | 235 |
| 803073 | 5178 | 5197 | 99184 | 99203 | GATGATAATTTCAGAGTTCT | 49 | 1241 |
| 803074 | 5187 | 5206 | 99193 | 99212 | ATATAGTCGGATGATAATTT | 53 | 1242 |
| 803075 | 5196 | 5215 | 99202 | 99221 | AGGCATTTCATATAGTCGGA | 11 | 1243 |
| 803076 | 5206 | 5225 | 99212 | 99231 | TTGGAAAATAAGGCATTTCA | 48 | 1244 |

TABLE 16-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803077 | 5227 | 5246 | 99233 | 99252 | TTAATCTTGACCAAAATCCC | 76 | 1245 |
| 803078 | 5236 | 5255 | 99242 | 99261 | ATCGATTGATTAATCTTGAC | 48 | 1246 |
| 803079 | 5245 | 5264 | 99251 | 99270 | TCTCAAGTAATCGATTGATT | 34 | 1247 |
| 803080 | 5270 | 5289 | 99276 | 99295 | CTCCCTGAAAGCATGTAAGG | 64 | 1248 |
| 803081 | 5294 | 5313 | 100146 | 100165 | CTGTTTGGGCGAAGTGCTCG | 45 | 1249 |
| 803082 | 5300 | 5319 | 100152 | 100171 | TACATTCTGTTTGGGCGAAG | 52 | 1250 |
| 803083 | 5301 | 5320 | 100153 | 100172 | ATACATTCTGTTTGGGCGAA | 40 | 1251 |
| 803084 | 5302 | 5321 | 100154 | 100173 | AATACATTCTGTTTGGGCGA | 33 | 1252 |
| 803085 | 5303 | 5322 | 100155 | 100174 | CAATACATTCTGTTTGGGCG | 39 | 1253 |
| 803086 | 5304 | 5323 | 100156 | 100175 | CCAATACATTCTGTTTGGGC | 48 | 1254 |
| 803087 | 5306 | 5325 | 100158 | 100177 | CGCCAATACATTCTGTTTGG | 36 | 1255 |
| 803088 | 5307 | 5326 | 100159 | 100178 | TCGCCAATACATTCTGTTTG | 44 | 1256 |
| 803089 | 5308 | 5327 | 100160 | 100179 | GTCGCCAATACATTCTGTTT | 57 | 1257 |
| 803090 | 5309 | 5328 | 100161 | 100180 | TGTCGCCAATACATTCTGTT | 55 | 1258 |
| 803091 | 5310 | 5329 | 100162 | 100181 | TTGTCGCCAATACATTCTGT | 62 | 1259 |
| 803092 | 5314 | 5333 | 100166 | 100185 | TGCCTTGTCGCCAATACATT | 46 | 1260 |
| 803093 | 5323 | 5342 | 100175 | 100194 | TTAAGTAAATGCCTTGTCGC | 61 | 1261 |
| 803094 | 5332 | 5351 | 100184 | 100203 | GAGACCAATTTAAGTAAATG | 63 | 1262 |
| 803095 | 5358 | 5377 | 100210 | 100229 | AGATCCTACCAGACAATAAG | 83 | 1263 |
| 803096 | 5367 | 5386 | 100219 | 100238 | TAAGACTTCAGATCCTACCA | 49 | 1264 |
| 803097 | 5376 | 5395 | 100228 | 100247 | ATGATTGTCTAAGACTTCAG | 38 | 1265 |
| 803098 | 5385 | 5404 | 100237 | 100256 | ACTCTCTGGATGATTGTCTA | 36 | 1266 |
| 803099 | 5405 | 5424 | 100257 | 100276 | GGAACTGTAATTTTTAAGAA | 98 | 1267 |
| 803100 | 5414 | 5433 | 100266 | 100285 | CTACAAGAAGGAACTGTAAT | 98 | 1268 |
| 803101 | 5423 | 5442 | N/A | N/A | CAGCCTTTTCTACAAGAAGG | 40 | 1269 |
| 803102 | 5449 | 5468 | 100438 | 100457 | GGTCCACAACTTGGCCCAAA | 28 | 1270 |
| 803103 | 5458 | 5477 | 100447 | 100466 | AATCAATGTGGTCCACAACT | 70 | 1271 |
| 803104 | 5467 | 5486 | 100456 | 100475 | CCATGAGAGAATCAATGTGG | 35 | 1272 |
| 803105 | 5476 | 5495 | 100465 | 100484 | ACCATTCTTCCATGAGAGAA | 36 | 1273 |
| 803106 | 5497 | 5516 | 100486 | 100505 | CAATCTCCAGCAACCCAGGA | 69 | 1274 |
| 803107 | 5507 | 5526 | 100496 | 100515 | CCACAAATATCAATCTCCAG | 45 | 1275 |
| 803108 | 5516 | 5535 | 100505 | 100524 | TCTCCTTCACCACAAATATC | 46 | 1276 |
| 803109 | 5533 | 5552 | 100522 | 100541 | ATTTCTTCAACAGAGTTTCT | 103 | 1277 |
| 803110 | 5534 | 5553 | 100523 | 100542 | CATTTCTTCAACAGAGTTTC | 64 | 1278 |
| 803111 | 5536 | 5555 | 100525 | 100544 | CCCATTTCTTCAACAGAGTT | 36 | 1279 |

TABLE 16-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803112 | 5538 | 5557 | 100527 | 100546 | TGCCCATTTCTTCAACAGAG | 22 | 1280 |
| 803113 | 5540 | 5559 | 100529 | 100548 | AATGCCCATTTCTTCAACAG | 53 | 1281 |
| 803114 | 5541 | 5560 | 100530 | 100549 | TAATGCCCATTTCTTCAACA | 67 | 1282 |
| 803115 | 5551 | 5570 | 100540 | 100559 | TAAAACTATATAATGCCCAT | 49 | 1283 |
| 803116 | 5560 | 5579 | 100549 | 100568 | CACCATCATTAAAACTATAT | 72 | 1284 |
| 803117 | 5586 | 5605 | 100575 | 100594 | ATCAAGTAAGATTTTTTGAT | 84 | 1285 |
| 803118 | 5595 | 5614 | 100584 | 100603 | CATCAAGTCATCAAGTAAGA | 70 | 1286 |
| 803119 | 5604 | 5623 | 100593 | 100612 | TGCTTTCTTCATCAAGTCAT | 80 | 1287 |
| 803120 | 5631 | 5650 | 101269 | 101288 | TGGATTTACTAAGAGATCTC | 36 | 1288 |
| 803121 | 5640 | 5659 | 101278 | 101297 | TGGTTGATCTGGATTTACTA | 49 | 1289 |
| 803122 | 5649 | 5668 | 101287 | 101306 | GGTGAGCCTTGGTTGATCTG | 28 | 1290 |
| 803123 | 5689 | 5708 | 101327 | 101346 | CAGCCAAAATCAAGTCAGGG | 29 | 1291 |
| 803124 | 5698 | 5717 | 101336 | 101355 | TAGGCAGGTCAGCCAAAATC | 47 | 1292 |
| 803125 | 5721 | 5740 | 101359 | 101378 | ATCATTATTCAACATAATAT | 78 | 1293 |
| 803126 | 5730 | 5749 | 101368 | 101387 | TTCCAACTCATCATTATTCA | 37 | 1294 |
| 803127 | 5739 | 5758 | 101377 | 101396 | TTGTTCAAATTCCAACTCAT | 79 | 1295 |
| 803128 | 5763 | 5782 | N/A | N/A | ATCACCTAGGAGAAACTCTG | 52 | 1296 |
| 803129 | 5772 | 5791 | N/A | N/A | AAAACTGCCATCACCTAGGA | 60 | 1297 |
| 803130 | 5781 | 5800 | 106472 | 106491 | AACTGATCCAAAACTGCCAT | 51 | 1298 |
| 803131 | 5807 | 5826 | 106498 | 106517 | TCTTCTCCTTCATAGGCTGC | 55 | 1299 |
| 803132 | 5816 | 5835 | 106507 | 106526 | ACAGCCACTTCTTCTCCTTC | 80 | 1300 |
| 803133 | 5825 | 5844 | 106516 | 106535 | AAAATCTTCACAGCCACTTC | 102 | 92 |
| 803134 | 5851 | 5870 | 106542 | 106561 | ACAGCCTGAGTGATGTATGT | 32* | 1301 |
| 803135 | 5860 | 5879 | 106551 | 106570 | CTTGTCTTAACAGCCTGAGT | 28* | 1302 |
| 803136 | 5869 | 5888 | N/A | N/A | CCACAAGCTCTTGTCTTAAC | 34* | 1303 |
| 803137 | 5909 | 5928 | 113106 | 113125 | AGCAAAGATATCAAACTGGG | 51* | 1304 |
| 803138 | 5918 | 5937 | 113115 | 113134 | CCAGCTGCCAGCAAAGATAT | 44* | 1305 |
| 803139 | 5927 | 5946 | 113124 | 113143 | GGACGAATCCCAGCTGCCAG | 42* | 1306 |
| 803140 | 5955 | 5974 | 113152 | 113171 | GGAGGCTAACTCCATCACCA | 35 | 1307 |
| 803141 | 5964 | 5983 | 113161 | 113180 | GGAACCCTTGGAGGCTAACT | 89 | 1308 |
| 803142 | 5973 | 5992 | 113170 | 113189 | GCGATCCAAGGAACCCTTGG | 91 | 1309 |
| 803143 | 5999 | 6018 | 113196 | 113215 | AGGCTGGCTTTGTCCTGCTG | 110 | 1310 |
| 803144 | 6008 | 6027 | 113205 | 113224 | GTTCTAGTGAGGCTGGCTTT | 75 | 1311 |
| 803145 | 6017 | 6036 | 113214 | 113233 | TGCTGTAGGGTTCTAGTGAG | 93 | 1312 |
| 803146 | 6052 | 6071 | N/A | N/A | ATCTCAAACCATCAGCTACG | 76 | 1313 |
| 803147 | 6061 | 6080 | N/A | N/A | AGTGGAGGTATCTCAAACCA | 85 | 1314 |

TABLE 16-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803148 | 6087 | 6106 | 118420 | 118439 | CAGGTCTCGGTATATAATCA | 69 | 1315 |
| 803149 | 6111 | 6130 | 118444 | 118463 | GAAAAGCAGCACATTGTGGG | 47 | 1316 |

TABLE 17

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 12 | 235 |
| 780254 | 4111 | 4130 | 86606 | 86625 | GTTTCATTCGGTTATAAGGC | 24 | 235 |
| 803150 | 6131 | 6150 | 118464 | 118483 | GCAGCATTGGGATACAGTGT | 53 | 1317 |
| 803151 | 6140 | 6159 | 118473 | 118492 | GCAATGATGGCAGCATTGGG | 59 | 1318 |
| 803152 | 6149 | 6168 | 118482 | 118501 | GCAATCTTTGCAATGATGGC | 56 | 159 |
| 803153 | 6189 | 6208 | 118522 | 118541 | TATCCCCATTCTACAGCAGT | 81 | 1319 |
| 803154 | 6198 | 6217 | 118531 | 118550 | TGATGTTTTATCCCCATTC | 98 | 1320 |
| 803155 | 6220 | 6239 | N/A | N/A | CACGAAACCCTGGTGTGCCC | 58 | 1321 |
| 803156 | 6229 | 6248 | 124860 | 124879 | CTTCAGGTGCACGAAACCCT | 101 | 1322 |
| 803157 | 6238 | 6257 | 124869 | 124888 | CTCTGGCAACTTCAGGTGCA | 65 | 1323 |
| 803158 | 6264 | 6283 | 124895 | 124914 | AGCCTGTTGGTTATAAATGA | 64 | 1324 |
| 803159 | 6273 | 6292 | 124904 | 124923 | ATAAACATCAGCCTGTTGGT | 83 | 1325 |
| 803160 | 6282 | 6301 | 124913 | 124932 | ACCAAATGAATAAACATCAG | 60 | 1326 |
| 803161 | 6308 | 6327 | 124939 | 124958 | GTTGTCAAAATGTCATAGAG | 57 | 1327 |
| 803162 | 6317 | 6336 | 124948 | 124967 | CTACCTCCAGTTGTCAAAAT | 72 | 1328 |
| 803163 | 6326 | 6345 | 124957 | 124976 | TCTACTATTCTACCTCCAGT | 57 | 1329 |
| 803164 | 6335 | 6354 | 124966 | 124985 | TTCAAACCCTCTACTATTCT | 85 | 1330 |
| 803165 | 6354 | 6373 | 124985 | 125004 | ATCAAACTCATTTGGAAACT | 71 | 1331 |
| 803166 | 6363 | 6382 | 124994 | 125013 | TTCTAATTCATCAAACTCAT | 90 | 1332 |
| 803167 | 6372 | 6391 | 125003 | 125022 | TCCTTGTATTTCTAATTCAT | 93 | 1333 |
| 803168 | 6398 | 6417 | N/A | N/A | TATTCTTTAACTGGATCAGG | 81 | 1334 |
| 803169 | 6407 | 6426 | 126523 | 126542 | GCACAACCATATTCTTTAAC | 70 | 1335 |
| 803170 | 6442 | 6461 | 126558 | 126577 | ACTGTTTAATTAATTTCTCA | 60 | 1336 |
| 803171 | 6451 | 6470 | 126567 | 126586 | CTTTCAAACACTGTTTAATT | 68 | 1337 |
| 803172 | 6460 | 6479 | 126576 | 126595 | GAGGATTTTCTTTCAAACAC | 39 | 1338 |
| 803173 | 6486 | 6505 | N/A | N/A | GACCTGGGCAGAAGTAGGCC | 62 | 1339 |

TABLE 17-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803174 | 6495 | 6514 | N/A | N/A | AATGTCAAAGACCTGGGCAG | 94 | 1340 |
| 803175 | 6504 | 6523 | 129649 | 129668 | TGAATTCAAAATGTCAAAGA | 113 | 1341 |
| 803176 | 6548 | 6567 | 129693 | 129712 | TTTTTAGGTAATAAAATGCG | 112 | 1342 |
| 803177 | 6577 | 6596 | 129722 | 129741 | GTGTAGCAACCATGCATTCA | 32 | 1343 |
| 803178 | 6586 | 6605 | 129731 | 129750 | TGTTGTGATGTGTAGCAACC | 54 | 162 |
| 803179 | 6595 | 6614 | 129740 | 129759 | CATTCCTGCTGTTGTGATGT | 66 | 1344 |
| 803180 | 6607 | 6626 | 129752 | 129771 | GCCAAATGCTTGCATTCCTG | 42 | 1345 |
| 803181 | 6608 | 6627 | 129753 | 129772 | AGCCAAATGCTTGCATTCCT | 38 | 1346 |
| 803182 | 6609 | 6628 | 129754 | 129773 | CAGCCAAATGCTTGCATTCC | 64 | 1347 |
| 803183 | 6610 | 6629 | 129755 | 129774 | CCAGCCAAATGCTTGCATTC | 53 | 1348 |
| 803184 | 6611 | 6630 | 129756 | 129775 | CCCAGCCAAATGCTTGCATT | 59 | 1349 |
| 803185 | 6613 | 6632 | 129758 | 129777 | AGCCCAGCCAAATGCTTGCA | 43 | 163 |
| 803186 | 6614 | 6633 | 129759 | 129778 | CAGCCCAGCCAAATGCTTGC | 73 | 1350 |
| 803187 | 6615 | 6634 | 129760 | 129779 | ACAGCCCAGCCAAATGCTTG | 97 | 1351 |
| 803188 | 6616 | 6635 | 129761 | 129780 | CACAGCCCAGCCAAATGCTT | 90 | 1352 |
| 803189 | 6617 | 6636 | 129762 | 129781 | CCACAGCCCAGCCAAATGCT | 104 | 1353 |
| 803190 | 6621 | 6640 | 129766 | 129785 | GTGCCCACAGCCCAGCCAAA | 60 | 1354 |
| 803191 | 6630 | 6649 | 129775 | 129794 | TCTGTCGGTGTGCCCACAGC | 77 | 1355 |
| 803192 | 6639 | 6658 | 129784 | 129803 | GAGCTGTCCTCTGTCGGTGT | 71 | 1356 |
| 803193 | 6665 | 6684 | 129810 | 129829 | CCTTCAGTATTTAAGTCAAG | 75 | 1357 |
| 803194 | 6674 | 6693 | 129819 | 129838 | GAAGTGTATCCTTCAGTATT | 76 | 1358 |
| 803195 | 6683 | 6702 | N/A | N/A | ACTTCCTCAGAAGTGTATCC | 89 | 1359 |
| 803196 | 6709 | 6728 | 132419 | 132438 | CTAAGCACAATATTCTACTA | 65 | 1360 |
| 803197 | 6718 | 6737 | 132428 | 132447 | GCACCAAGGCTAAGCACAAT | 54 | 1361 |
| 803198 | 6727 | 6746 | 132437 | 132456 | CAGGAAGATGCACCAAGGCT | 53 | 1362 |
| 803199 | 6753 | 6772 | 132463 | 132482 | AGACACAATCCAGCTTTCCT | 113 | 1363 |
| 803200 | 6762 | 6781 | 132472 | 132491 | CTGTGTCCCAGACACAATCC | 91 | 1364 |
| 803201 | 6771 | 6790 | 132481 | 132500 | AGTACCAGACTGTGTCCCAG | 74 | 1365 |
| 803202 | 6797 | 6816 | 132507 | 132526 | CCATCTTCGGTATTGATGAC | 57 | 1366 |
| 803203 | 6806 | 6825 | 132516 | 132535 | CTCTTTTTCCCATCTTCGGT | 61 | 1367 |
| 803204 | 6815 | 6834 | 132525 | 132544 | AGGGTATGTCTCTTTTTCCC | 42 | 1368 |
| 803205 | 6841 | 6860 | 132551 | 132570 | AAGTGACAGAATCAGTCATC | 71 | 52 |
| 803206 | 6850 | 6869 | 132560 | 132579 | AATACAAACAAGTGACAGAA | 98 | 1369 |
| 803207 | 6864 | 6883 | 132574 | 132593 | GGAAAAGGAATTGCAATACA | 76 | 1370 |
| 803208 | 6902 | 6921 | 134234 | 134253 | GTTCCAACCAAAAGAAAATT | 86 | 1371 |
| 803209 | 6911 | 6930 | 134243 | 134262 | CCATCAGCGGTTCCAACCAA | 55 | 1372 |

TABLE 17-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803210 | 6929 | 6948 | 134261 | 134280 | TCAAAAATTGCTAACTTGCC | 111 | 1373 |
| 803211 | 6938 | 6957 | 134270 | 134289 | GTCTTATCTTCAAAATTGC | 92 | 1374 |
| 803212 | 6947 | 6966 | N/A | N/A | AGCTTAACAGTCTTATCTTC | 94 | 1375 |
| 803213 | 6973 | 6992 | 137377 | 137396 | GTATCTTCAAAGGAGCAGCT | 72 | 1376 |
| 803214 | 6983 | 7002 | 137387 | 137406 | CCTATATTTAGTATCTTCAA | 54 | 1377 |
| 803215 | 6992 | 7011 | 137396 | 137415 | CTGACATTTCCTATATTTAG | 73 | 1378 |
| 803216 | 7017 | 7036 | 137421 | 137440 | TTCACTCAAACACATCAATG | 68 | 1379 |
| 803217 | 7026 | 7045 | 137430 | 137449 | ATTTGTGGATTCACTCAAAC | 72 | 1380 |
| 803218 | 7035 | 7054 | 137439 | 137458 | TTCCGTTGAATTTGTGGATT | 85 | 1381 |
| 803219 | 7061 | 7080 | 137465 | 137484 | CCACATCCTCCCCACATTAC | 62 | 1382 |
| 803220 | 7070 | 7089 | 137474 | 137493 | ATCTTTGTGCCACATCCTCC | 77 | 1383 |
| 803221 | 7087 | 7106 | 137491 | 137510 | CATTAGAAAAGGAGAAAATC | 85 | 1384 |
| 803222 | 7105 | 7124 | 137509 | 137528 | GTTTCTGAATGGTGAAATCA | 76 | 1385 |
| 803223 | 7114 | 7133 | 137518 | 137537 | TCTCAATGAGTTTCTGAATG | 74 | 1386 |
| 803224 | 7123 | 7142 | 137527 | 137546 | TTGTTCTTGTCTCAATGAGT | 100 | 1387 |
| 803225 | 7132 | 7151 | 137536 | 137555 | ACAGTTGGCTTGTTCTTGTC | 104 | 1388 |
| 803226 | 7150 | 7169 | 141511 | 141530 | TGAAAGCTGCATAAGAAAAC | 116 | 1389 |

TABLE 18

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 25 | 235 |
| 780254 | 4111 | 4130 | 86606 | 86625 | GTTTCATTCGGTTATAAGGC | 20 | 235 |
| 803227 | 7159 | 7178 | 141520 | 141539 | TGGAATCACTGAAAGCTGCA | 65 | 1390 |
| 803228 | 7168 | 7187 | 141529 | 141548 | TTATGATGTTGGAATCACTG | 60 | 1391 |
| 803229 | 7194 | 7213 | 141555 | 141574 | ATAGAGAGCAGTGTCTACCA | 66 | 1392 |
| 803230 | 7203 | 7222 | 141564 | 141583 | CTTAGCAATATAGAGAGCAG | 97 | 1393 |
| 803231 | 7212 | 7231 | 141573 | 141592 | GCTATTTTGCTTAGCAATAT | 46 | 1394 |
| 803232 | 7238 | 7257 | 141599 | 141618 | TTCTTATCCCACACTTCCAC | 89 | 1395 |
| 803233 | 7248 | 7267 | 141609 | 141628 | TTTTTCAGTTTTCTTATCCC | 75 | 1396 |
| 803234 | 7257 | 7276 | 141618 | 141637 | TCCACAGAGTTTTTCAGTTT | 64 | 1397 |
| 803235 | 7282 | 7301 | 141643 | 141662 | TTAAAAGTGCACGCAGTCT | 108 | 1398 |

TABLE 18-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803236 | 7291 | 7310 | N/A | N/A | TTACCTCCCTTAAAAAGTGC | 95 | 1399 |
| 803237 | 7300 | 7319 | N/A | N/A | CTTTTACCATTACCTCCCTT | 80 | 1400 |
| 803238 | 7309 | 7328 | 142957 | 142976 | CCTTGTTTTCTTTTACCATT | 65 | 1401 |
| 803239 | 7339 | 7358 | 142987 | 143006 | TCCCAGAATAAGACATTTTG | 68 | 1402 |
| 803240 | 7348 | 7367 | 142996 | 143015 | TTTTCACTCTCCCAGAATAA | 62 | 1403 |
| 803241 | 7371 | 7390 | 143019 | 143038 | AGTGTTCTTCTGAAGGCAGA | 60 | 1404 |
| 803242 | 7380 | 7399 | 143028 | 143047 | CCAAAGAGCAGTGTTCTTCT | 86 | 1405 |
| 803243 | 7389 | 7408 | 143037 | 143056 | AGTTCCTATCCAAAGAGCAG | 87 | 1406 |
| 803244 | 7415 | 7434 | 143063 | 143082 | TCCAGGAGTAAAATATGGCC | 51 | 1407 |
| 803245 | 7424 | 7443 | 143072 | 143091 | GTTGAAAGATCCAGGAGTAA | 106 | 1408 |
| 803246 | 7433 | 7452 | 143081 | 143100 | AGTCGACGAGTTGAAAGATC | 106 | 1409 |
| 803247 | 7466 | 7485 | 143114 | 143133 | ACCGAATTACAAAAGTTGTA | 71 | 1410 |
| 803248 | 7475 | 7494 | 143123 | 143142 | ATGACTCTGACCGAATTACA | 82 | 1411 |
| 803249 | 7484 | 7503 | 143132 | 143151 | GCTGTCATCATGACTCTGAC | 65 | 1412 |
| 803250 | 7510 | 7529 | 145113 | 145132 | TGACATTTTTAAGGCTTCCT | 58 | 1413 |
| 803251 | 7522 | 7541 | 145125 | 145144 | CCAATACCAGCATGACATTT | 75 | 1414 |
| 803252 | 7531 | 7550 | 145134 | 145153 | GGTTGTAGCCCAATACCAGC | 74 | 1415 |
| 803253 | 7554 | 7573 | 145157 | 145176 | TTGTGTACCTTCAGTATTTT | 61 | 1416 |
| 803254 | 7564 | 7583 | 145167 | 145186 | CTTTCTGCTTTTGTGTACCT | 92 | 1417 |
| 803255 | 7573 | 7592 | N/A | N/A | ATTGTATCTCTTTCTGCTTT | 104 | 1418 |
| 803256 | 7598 | 7617 | 145767 | 145786 | TTGATGTCCCAAACGGTCAA | 49 | 1419 |
| 803257 | 7607 | 7626 | 145776 | 145795 | TGTGGAAGATTGATGTCCCA | 96 | 1420 |
| 803258 | 7616 | 7635 | 145785 | 145804 | TGCACTTCATGTGGAAGATT | 74 | 1421 |
| 803259 | 7625 | 7644 | 145794 | 145813 | TCTAAATTTTGCACTTCATG | 71 | 1422 |
| 803260 | 7645 | 7664 | 145814 | 145833 | TTCTCACTTCAATGTGTTTT | 48 | 1423 |
| 803261 | 7654 | 7673 | 145823 | 145842 | CTAATTCTTTTCTCACTTCA | 93 | 1424 |
| 803262 | 7666 | 7685 | 145835 | 145854 | TCATTTTTTCAGCTAATTCT | 95 | 1425 |
| 803263 | 7697 | 7716 | 145866 | 145885 | CTATTTCTCTCTTACTCAAC | 77 | 1426 |
| 803264 | 7706 | 7725 | 145875 | 145894 | AGACAATTCCTATTTCTCTC | 45 | 1427 |
| 803265 | 7717 | 7736 | 145886 | 145905 | TTCCTATCCAAAGACAATTC | 83 | 1428 |
| 803266 | 7741 | 7760 | 145910 | 145929 | TATTTACAAGAGGAGAGAAT | 75 | 1429 |
| 803267 | 7771 | 7790 | 145940 | 145959 | CCCTTTCCATGTGAACATTT | 65 | 1430 |
| 803268 | 7772 | 7791 | 145941 | 145960 | ACCCTTTCCATGTGAACATT | 49 | 1431 |
| 803269 | 7773 | 7792 | 145942 | 145961 | TACCCTTTCCATGTGAACAT | 49 | 1432 |
| 803270 | 7774 | 7793 | 145943 | 145962 | GTACCCTTTCCATGTGAACA | 41 | 1433 |
| 803271 | 7775 | 7794 | 145944 | 145963 | AGTACCCTTTCCATGTGAAC | 54 | 1434 |

TABLE 18-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803272 | 7777 | 7796 | 145946 | 145965 | TGAGTACCCTTTCCATGTGA | 43 | 1435 |
| 803273 | 7778 | 7797 | 145947 | 145966 | GTGAGTACCCTTTCCATGTG | 44 | 1436 |
| 803274 | 7779 | 7798 | 145948 | 145967 | TGTGAGTACCCTTTCCATGT | 66 | 1437 |
| 803275 | 7780 | 7799 | 145949 | 145968 | ATGTGAGTACCCTTTCCATG | 37 | 1438 |
| 803276 | 7781 | 7800 | 145950 | 145969 | AATGTGAGTACCCTTTCCAT | 57 | 1439 |
| 803277 | 7785 | 7804 | 145954 | 145973 | AAAAAATGTGAGTACCCTTT | 68 | 1440 |
| 803278 | 7794 | 7813 | 145963 | 145982 | AGCTATTTCAAAAAATGTGA | 89 | 1441 |
| 803279 | 7803 | 7822 | 145972 | 145991 | ATACACACGAGCTATTTCAA | 76 | 1442 |
| 803280 | 7812 | 7831 | 145981 | 146000 | CATTCCTTCATACACACGAG | 57 | 1443 |
| 803281 | 7850 | 7869 | 146019 | 146038 | GTAAGTATTTTACATATAT | 69 | 1444 |
| 803282 | 7876 | 7895 | 146045 | 146064 | TAGTTCTTTAAAATACACAT | 58 | 1445 |
| 803283 | 7888 | 7907 | 146057 | 146076 | TTGTGTTTTAAATAGTTCTT | 56 | 1446 |
| 803284 | 7897 | 7916 | 146066 | 146085 | AATATAACATTGTGTTTTAA | 95 | 1447 |
| 803285 | 7921 | 7940 | 146090 | 146109 | CGAAAGTAACTGGTATTTAT | 40 | 1448 |
| 803286 | 7930 | 7949 | 146099 | 146118 | ATTAATGAACGAAAGTAACT | 125 | 1449 |
| 803287 | 7939 | 7958 | 146108 | 146127 | TTTTCATTAATTAATGAACG | 99 | 1450 |
| 803288 | 7948 | 7967 | 146117 | 146136 | ACAGATTTATTTTCATTAAT | 82 | 1451 |
| 803289 | 7969 | 7988 | 146138 | 146157 | AGTACTTAAATTAGGTACTT | 126 | 1452 |
| 803290 | 7978 | 7997 | 146147 | 146166 | TTTAGTATGAGTACTTAAAT | 102 | 1453 |
| 803291 | 7987 | 8006 | 146156 | 146175 | CTTATAAATTTTAGTATGAG | 98 | 1454 |
| 803292 | 8019 | 8038 | 146188 | 146207 | CATTACAGACAAGAAAACAA | 109 | 1455 |
| 803293 | 8028 | 8047 | 146197 | 146216 | GTTTACCTCCATTACAGACA | 61 | 1456 |
| 803294 | 8037 | 8056 | 146206 | 146225 | TAAAATAAAGTTTACCTCCA | 59 | 1457 |
| 803295 | 8061 | 8080 | 146230 | 146249 | TAGTCCTGTCTTAAGCACAG | 74 | 1458 |
| 803296 | 8070 | 8089 | 146239 | 146258 | GACAAGCAATAGTCCTGTCT | 66 | 1459 |
| 803297 | 8079 | 8098 | 146248 | 146267 | AGAAAAATCGACAAGCAATA | 89 | 1460 |
| 803298 | 8105 | 8124 | 146274 | 146293 | ATTTTCATTATACCGTGCAG | 55 | 1461 |
| 803299 | 8116 | 8135 | 146285 | 146304 | ACTGTCTTAATATTTTCATT | 53 | 1462 |
| 803300 | 8125 | 8144 | 146294 | 146313 | ACATGGGAAACTGTCTTAAT | 56 | 1463 |
| 803301 | 8149 | 8168 | 146318 | 146337 | ATGCAATCTAAGAAGGAATA | 67 | 1464 |
| 803302 | 8158 | 8177 | 146327 | 146346 | TGCATTTCGATGCAATCTAA | 36 | 1465 |
| 803303 | 8167 | 8186 | 146336 | 146355 | ATATGATAGTGCATTTCGAT | 69 | 1466 |

TABLE 19

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 27 | 235 |
| 780254 | 4111 | 4130 | 86606 | 86625 | GTTTCATTCGGTTATAAGGC | 12 | 235 |
| 803304 | 8176 | 8195 | 146345 | 146364 | TACAAGCATATATGATAGTG | 83 | 1467 |
| 803305 | 8207 | 8226 | 146376 | 146395 | GACTTTATTAGTGCAAATTC | 54 | 1468 |
| 803306 | 8208 | 8227 | 146377 | 146396 | GGACTTTATTAGTGCAAATT | 45 | 1469 |
| 803307 | 8209 | 8228 | 146378 | 146397 | AGGACTTTATTAGTGCAAAT | 54 | 1470 |
| 803308 | 8210 | 8229 | 146379 | 146398 | AAGGACTTTATTAGTGCAAA | 56 | 1471 |
| 803309 | 8212 | 8231 | 146381 | 146400 | CAAAGGACTTTATTAGTGCA | 59 | 1472 |
| 803310 | 8213 | 8232 | 146382 | 146401 | ACAAAGGACTTTATTAGTGC | 58 | 1473 |
| 803311 | 8214 | 8233 | 146383 | 146402 | AACAAAGGACTTTATTAGTG | 63 | 1474 |
| 803312 | 8215 | 8234 | 146384 | 146403 | CAACAAAGGACTTTATTAGT | 101 | 1475 |
| 803313 | 8240 | 8259 | 146409 | 146428 | ACAGCAACAAAGAGAATTCA | 88 | 1476 |
| 803314 | 8252 | 8271 | 146421 | 146440 | GCACTGTTTGCAACAGCAAC | 91 | 1477 |
| 803315 | 8261 | 8280 | 146430 | 146449 | GTGTAAGATGCACTGTTTGC | 74 | 1478 |
| 803316 | 8284 | 8303 | 146453 | 146472 | TTTCTTTTGAATTGAGTGAA | 92 | 1479 |
| 803317 | 8293 | 8312 | 146462 | 146481 | TAATGGAGTTTCTTTTGAA | 87 | 1480 |
| 803318 | 8302 | 8321 | 146471 | 146490 | TAGTACTTTTAATGGAGTTT | 115 | 1481 |
| 803319 | 8328 | 8347 | 146497 | 146516 | TTTGACAGTATGTCATGTTT | 118 | 1482 |
| 803320 | 8337 | 8356 | 146506 | 146525 | TATGAGGACTTTGACAGTAT | 101 | 1483 |
| 803321 | 8346 | 8365 | 146515 | 146534 | TTTCCTAGATATGAGGACTT | 121 | 1484 |
| 803322 | 8355 | 8374 | 146524 | 146543 | TTCTGTGTCTTTCCTAGATA | 125 | 1485 |
| 803323 | 8373 | 8392 | 146542 | 146561 | TTCTGTGACAAAGAGAGTTT | 73 | 1486 |
| 803324 | 8382 | 8401 | 146551 | 146570 | ACAGAGAGTTTCTGTGACAA | 85 | 1487 |
| 803325 | 8391 | 8410 | 146560 | 146579 | AGGAAAGACACAGAGAGTTT | 100 | 1488 |
| 803326 | 8418 | 8437 | 146587 | 146606 | GAGTTGAAAAACAACTCTAT | 129 | 1489 |
| 803327 | 8427 | 8446 | 146596 | 146615 | TCAAACATAGAGTTGAAAAA | 116 | 1490 |
| 803328 | 8436 | 8455 | 146605 | 146624 | TATCCACATTCAAACATAGA | 116 | 1491 |
| 803329 | 8461 | 8480 | 146630 | 146649 | TACACTAATTATACAAAATT | 114 | 1492 |
| 803330 | 8470 | 8489 | 146639 | 146658 | CACTGTATTTACACTAATTA | 73 | 1493 |
| 803331 | 8479 | 8498 | 146648 | 146667 | AGGACTGAACACTGTATTTA | 56 | 1494 |
| 803332 | 8488 | 8507 | 146657 | 146676 | ATCACTTGAAGGACTGAACA | 73 | 1495 |
| 803333 | 8524 | 8543 | 146693 | 146712 | ACAAGTAGCTAGTGGTATGA | 85 | 1496 |
| 803334 | 8533 | 8552 | 146702 | 146721 | GATTAGAAAACAAGTAGCTA | 69 | 1497 |
| 803335 | 8545 | 8564 | 146714 | 146733 | TAGAATGAAGCAGATTAGAA | 116 | 1498 |
| 803336 | 8570 | 8589 | 146739 | 146758 | TTAGGGAAAGATGAATATA | 93 | 1499 |
| 803337 | 8579 | 8598 | 146748 | 146767 | ATCACAAATTTAGGGAAAAG | 72 | 1500 |

TABLE 19-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803338 | 8588 | 8607 | 146757 | 146776 | ATCTGCAGCATCACAAATTT | 77 | 1501 |
| 803339 | 8614 | 8633 | 146783 | 146802 | AAAGGTTTCTATCTGAATGA | 107 | 1502 |
| 803340 | 8639 | 8658 | 146808 | 146827 | GGAATTCTATAATTCTGAAA | 80 | 1503 |
| 803341 | 8659 | 8678 | 146828 | 146847 | ATGGTCTTGGTAGGAGCTGT | 77 | 1504 |
| 803342 | 8668 | 8687 | 146837 | 146856 | TTTATCCTCATGGTCTTGGT | 56 | 1505 |
| 803343 | 8677 | 8696 | 146846 | 146865 | TGTTAGATATTTATCCTCAT | 66 | 1506 |
| 803344 | 8705 | 8724 | 146874 | 146893 | GCTCCTTTCTCCTTCAGCAA | 58 | 1507 |
| 803345 | 8714 | 8733 | 146883 | 146902 | ATAACTAAAGCTCCTTTCTC | 111 | 1508 |
| 803346 | 8723 | 8742 | 146892 | 146911 | TTATCCATCATAACTAAAGC | 112 | 1509 |
| 803347 | 8732 | 8751 | 146901 | 146920 | CAGATATTTTATCCATCAT | 57 | 1510 |
| 803348 | 8750 | 8769 | 146919 | 146938 | TTTGGAAGCCTAGGGTGGCA | 80 | 1511 |
| 803349 | 8759 | 8778 | 146928 | 146947 | TAAGTATAATTTGGAAGCCT | 69 | 1512 |
| 803350 | 8768 | 8787 | 146937 | 146956 | TAAACAATTTAAGTATAATT | 121 | 1513 |
| 803351 | 8794 | 8813 | 146963 | 146982 | TGATACTCCTATTGTGGTAA | 89 | 1514 |
| 803352 | 8803 | 8822 | 146972 | 146991 | ATTTGGCCCTGATACTCCTA | 71 | 1515 |
| 803353 | 8812 | 8831 | 146981 | 147000 | TACATAGGTATTTGGCCCTG | 111 | 1516 |
| 803354 | 8838 | 8857 | 147007 | 147026 | CTAAAGCAGAAATGACCTCA | 61 | 1517 |
| 803355 | 8847 | 8866 | 147016 | 147035 | GTACTTTTCCTAAAGCAGAA | 74 | 1518 |
| 803356 | 8856 | 8875 | 147025 | 147044 | TTACCGAAAGTACTTTTCCT | 89 | 1519 |
| 803357 | 8882 | 8901 | 147051 | 147070 | ATGAATACTGGTCAGGGCCA | 102 | 61 |
| 803358 | 8891 | 8910 | 147060 | 147079 | TCTGAAATAATGAATACTGG | 85 | 1520 |
| 803359 | 8900 | 8919 | 147069 | 147088 | AGGGAATTATCTGAAATAAT | 46 | 1521 |
| 803360 | 8926 | 8945 | 147095 | 147114 | ATTAAATGTACTAGTTGTCC | 90 | 1522 |
| 803361 | 8935 | 8954 | 147104 | 147123 | TCTGAGAATATTAAATGTAC | 66 | 1523 |
| 803362 | 8944 | 8963 | 147113 | 147132 | GCCATAAGTTCTGAGAATAT | 53 | 1524 |
| 803363 | 8953 | 8972 | 147122 | 147141 | TAGTAAAATGCCATAAGTTC | 79 | 1525 |
| 803364 | 8957 | 8976 | 147126 | 147145 | CACATAGTAAAATGCCATAA | 51 | 1526 |
| 803365 | 8958 | 8977 | 147127 | 147146 | TCACATAGTAAAATGCCATA | 63 | 1527 |
| 803366 | 8959 | 8978 | 147128 | 147147 | TTCACATAGTAAAATGCCAT | 43 | 1528 |
| 803367 | 8960 | 8979 | 147129 | 147148 | TTTCACATAGTAAAATGCCA | 55 | 1529 |
| 803368 | 8961 | 8980 | 147130 | 147149 | TTTTCACATAGTAAAATGCC | 80 | 1530 |
| 803369 | 8963 | 8982 | 147132 | 147151 | AGTTTTCACATAGTAAAATG | 101 | 1531 |
| 803370 | 8964 | 8983 | 147133 | 147152 | AAGTTTTCACATAGTAAAAT | 133 | 1532 |
| 803371 | 8965 | 8984 | 147134 | 147153 | AAAGTTTTCACATAGTAAAA | 77 | 1533 |
| 803372 | 8966 | 8985 | 147135 | 147154 | TAAAGTTTTCACATAGTAAA | 88 | 1534 |

TABLE 19-continued

Percent control of human LRRK RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803373 | 8967 | 8986 | 147136 | 147155 | TTAAAGTTTTCACATAGTAA | 97 | 1535 |
| 803374 | 8972 | 8991 | 147141 | 147160 | TAAATTTAAAGTTTTCACAT | 104 | 1536 |
| 803375 | 8988 | 9007 | 147157 | 147176 | TTACCCTTAATATAAATAAA | 113 | 1537 |
| 803376 | 8997 | 9016 | 147166 | 147185 | AGAATTTGATTACCCTTAAT | 82 | 1538 |
| 803377 | 9015 | 9034 | 147184 | 147203 | GAAAATCTTTCATCTTTAAG | 116 | 1539 |
| 803378 | 9028 | 9047 | 147197 | 147216 | CCTTTAAAATACAGAAAATC | 110 | 1540 |
| 803379 | 9037 | 9056 | 147206 | 147225 | GCATAGCTTCCTTTAAAATA | 70 | 1541 |
| 803380 | 9059 | 9078 | 147228 | 147247 | GTTAATTACATAACAAGTTA | 76 | 1542 |

TABLE 20

Percent control of human LRRK RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 25 | 235 |
| 780254 | 4111 | 4130 | 86606 | 86625 | GTTTCATTCGGTTATAAGGC | 20 | 235 |
| 803381 | 9078 | 9097 | 147247 | 147266 | TATTATATATGATTTTTTTG | 96 | 1543 |
| 803382 | 9103 | 9122 | 147272 | 147291 | GAGATAACACTGGAACAAAG | 79 | 1544 |
| 803383 | 9112 | 9131 | 147281 | 147300 | ACAATGAAAGAGATAACACT | 96 | 1545 |
| 803384 | 9125 | 9144 | 147294 | 147313 | CAAATACAAAGTAACAATGA | 119 | 1546 |
| 803385 | 9164 | 9183 | 147333 | 147352 | GTATTCATTTTTTTAATTTG | 95 | 1547 |
| 803386 | N/A | N/A | 3733 | 3752 | TACCTGCTGCACACTCGCGA | 32 | 1548 |
| 803387 | N/A | N/A | 4361 | 4380 | ATCCAAGATACATAGCAAAT | 61 | 1549 |
| 803388 | N/A | N/A | 4768 | 4787 | TAATAGTCAGATGGAAAATA | 92 | 1550 |
| 803389 | N/A | N/A | 5023 | 5042 | TATCAAGCAGGAGTGACTCT | 81 | 1551 |
| 803390 | N/A | N/A | 5210 | 5229 | CTCTCTAGGCAGAAATACTA | 87 | 1552 |
| 803391 | N/A | N/A | 5227 | 5246 | ATACTTTGCCTCTGGTACTC | 80 | 1553 |
| 803392 | N/A | N/A | 5291 | 5310 | CAACTATGATATATCCAAAA | 139 | 1554 |
| 803393 | N/A | N/A | 7598 | 7617 | AAAAGATAGGCAGGAAAAGA | 185 | 1555 |
| 803394 | N/A | N/A | 8034 | 8053 | TGCCAAACTCATCTCTGTAC | 76 | 1556 |
| 803395 | N/A | N/A | 8402 | 8421 | GTAAACAACGGCTATTTTAG | 65 | 1557 |
| 803396 | N/A | N/A | 10211 | 10230 | CCCAGAAACAAAAGCAAGCC | 70 | 1558 |
| 803397 | N/A | N/A | 11602 | 11621 | GTACTGAAAACAAGAAGAGC | 96 | 1559 |
| 803398 | N/A | N/A | 11762 | 11781 | GGACATTTAAAGTTACAATT | 66 | 1560 |
| 803399 | N/A | N/A | 12023 | 12042 | TCTTCTTCACAACTGCATGG | 71 | 1561 |

TABLE 20-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803400 | N/A | N/A | 12348 | 12367 | TTTACATTATTGGAAGAAGA | 84 | 1562 |
| 803401 | N/A | N/A | 12349 | 12368 | CTTTACATTATTGGAAGAAG | 96 | 1563 |
| 803402 | N/A | N/A | 12350 | 12369 | GCTTTACATTATTGGAAGAA | 64 | 1564 |
| 803403 | N/A | N/A | 12351 | 12370 | GGCTTTACATTATTGGAAGA | 46 | 1565 |
| 803404 | N/A | N/A | 12352 | 12371 | TGGCTTTACATTATTGGAAG | 52 | 1566 |
| 803405 | N/A | N/A | 12354 | 12373 | TTTGGCTTTACATTATTGGA | 69 | 1567 |
| 803406 | N/A | N/A | 12355 | 12374 | GTTTGGCTTTACATTATTGG | 40 | 1568 |
| 803407 | N/A | N/A | 12356 | 12375 | TGTTTGGCTTTACATTATTG | 68 | 1569 |
| 803408 | N/A | N/A | 12357 | 12376 | TTGTTTGGCTTTACATTATT | 85 | 1570 |
| 803409 | N/A | N/A | 12358 | 12377 | ATTGTTTGGCTTTACATTAT | 57 | 1571 |
| 803410 | N/A | N/A | 13200 | 13219 | GAATAATTCACAATGTACAC | 64 | 1572 |
| 803411 | N/A | N/A | 13280 | 13299 | CATGTGTGTTTGTTCTTTC | 70 | 1573 |
| 803412 | N/A | N/A | 14768 | 14787 | ATTCAAACCTTCCCAATCAC | 131 | 1574 |
| 803413 | N/A | N/A | 14988 | 15007 | TCCATCGCCAAATGGAGAAT | 102 | 1575 |
| 803414 | N/A | N/A | 15083 | 15102 | AATACTGGAATAGGAGTAGT | 98 | 1576 |
| 803415 | N/A | N/A | 15343 | 15362 | TCTCATGATCCTTAGTATGA | 72 | 1577 |
| 803416 | N/A | N/A | 15717 | 15736 | ACCTGGCCTACTCCTGTTCC | 95 | 1578 |
| 803417 | N/A | N/A | 16619 | 16638 | ATGCATATTAGTCTTTTTCC | 61 | 1579 |
| 803418 | N/A | N/A | 18995 | 19014 | CTGCCACTGTAATCACCTCT | 54 | 1580 |
| 803419 | N/A | N/A | 19777 | 19796 | TACATATTGTCTAATAATCC | 114 | 1581 |
| 803420 | N/A | N/A | 20043 | 20062 | TTTGTTGGCAGTGATGTCTC | 49 | 1582 |
| 803421 | N/A | N/A | 20233 | 20252 | TTAAAAACTTTTGATTTCTT | 131 | 1583 |
| 803422 | N/A | N/A | 20684 | 20703 | AAGGGCAACCAATGTACAAG | 43 | 1584 |
| 803423 | N/A | N/A | 20708 | 20727 | TATGACCTGTTTCCTCCATT | 60 | 1585 |
| 803424 | N/A | N/A | 20709 | 20728 | CTATGACCTGTTTCCTCCAT | 82 | 1586 |
| 803425 | N/A | N/A | 20710 | 20729 | GCTATGACCTGTTTCCTCCA | 37 | 1587 |
| 803426 | N/A | N/A | 20711 | 20730 | AGCTATGACCTGTTTCCTCC | 43 | 1588 |
| 803427 | N/A | N/A | 20712 | 20731 | CAGCTATGACCTGTTTCCTC | 35 | 1589 |
| 803428 | N/A | N/A | 20714 | 20733 | ATCAGCTATGACCTGTTTCC | 69 | 1590 |
| 803429 | N/A | N/A | 20715 | 20734 | AATCAGCTATGACCTGTTTC | 70 | 1591 |
| 803430 | N/A | N/A | 20717 | 20736 | AAAATCAGCTATGACCTGTT | 72 | 1592 |
| 803431 | N/A | N/A | 20718 | 20737 | TAAAATCAGCTATGACCTGT | 88 | 1593 |
| 803432 | N/A | N/A | 21079 | 21098 | ATGTGGTGAATATTATAGAA | 38 | 1594 |
| 803433 | N/A | N/A | 21236 | 21255 | CTTTATTGAAAATTGCCACA | 43 | 1595 |
| 803434 | N/A | N/A | 22179 | 22198 | CATTTAAGTTGGATAGTGAG | 80 | 1596 |

TABLE 20-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803435 | N/A | N/A | 23283 | 23302 | GGAATAAAATATACAATATA | 86 | 1597 |
| 803436 | N/A | N/A | 23734 | 23753 | AGTTCTTCTTAAAATGATCC | 34 | 1598 |
| 803437 | N/A | N/A | 24259 | 24278 | AAGCCCACATTGAAAAACA | 80 | 1599 |
| 803438 | N/A | N/A | 24494 | 24513 | TGAAAATAAACAGAGAAGAT | 93 | 1600 |
| 803439 | N/A | N/A | 24497 | 24516 | ATGTGAAAATAAACAGAGAA | 97 | 1601 |
| 803440 | N/A | N/A | 24663 | 24682 | AGCCTAGAAGCAGTTGGTTT | 88 | 1602 |
| 803441 | N/A | N/A | 25966 | 25985 | AATAATAACAATATCCCATC | 83 | 1603 |
| 803442 | N/A | N/A | 26005 | 26024 | AAGATTGATGAACCACAGGA | 51 | 1604 |
| 803443 | N/A | N/A | 26046 | 26065 | ATTTCATCCCTTACTGCTTA | 123 | 1605 |
| 803444 | N/A | N/A | 26583 | 26602 | AGAGATAATCAAGAGAAAAA | 104 | 1606 |
| 803445 | N/A | N/A | 27062 | 27081 | AGTATGGAGCTCCTTTACCA | 66 | 1607 |
| 803446 | N/A | N/A | 28223 | 28242 | TACATTGAGATGTGTATATT | 111 | 1608 |
| 803447 | N/A | N/A | 29215 | 29234 | TGCTTTAGGAGAAGCCTTGG | 62 | 1609 |
| 803448 | N/A | N/A | 29216 | 29235 | GTGCTTTAGGAGAAGCCTTG | 41 | 1610 |
| 803449 | N/A | N/A | 29217 | 29236 | TGTGCTTTAGGAGAAGCCTT | 36 | 1611 |
| 803450 | N/A | N/A | 29218 | 29237 | GTGTGCTTTAGGAGAAGCCT | 34 | 1612 |
| 803451 | N/A | N/A | 29219 | 29238 | GGTGTGCTTTAGGAGAAGCC | 40 | 1613 |
| 803452 | N/A | N/A | 29221 | 29240 | GAGGTGTGCTTTAGGAGAAG | 58 | 1614 |
| 803453 | N/A | N/A | 29222 | 29241 | TGAGGTGTGCTTTAGGAGAA | 56 | 1615 |
| 803454 | N/A | N/A | 29223 | 29242 | ATGAGGTGTGCTTTAGGAGA | 80 | 1616 |
| 803455 | N/A | N/A | 29224 | 29243 | AATGAGGTGTGCTTTAGGAG | 68 | 1617 |
| 803456 | N/A | N/A | 29225 | 29244 | GAATGAGGTGTGCTTTAGGA | 63 | 1618 |
| 803457 | N/A | N/A | 29927 | 29946 | ATTTTAAAACGATCAGCCAG | 87 | 1619 |

TABLE 21

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 16 | 235 |
| 780254 | 4111 | 4130 | 86606 | 86625 | GTTTCATTCGGTTATAAGGC | 28 | 235 |
| 803458 | N/A | N/A | 30062 | 30081 | AGTTGGGAACTCATCATAGG | 79 | 1620 |
| 803459 | N/A | N/A | 30238 | 30257 | AGGCTCACGGATATGAAACA | 59 | 1621 |
| 803460 | N/A | N/A | 30698 | 30717 | AAGAGAGGAAAAACTGAAAA | 83 | 1622 |
| 803461 | N/A | N/A | 31335 | 31354 | GTTTACACATAGAAGTCCGG | 46 | 1623 |

TABLE 21-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803462 | N/A | N/A | 32129 | 32148 | TAAAGGGATACAAGCCATTT | 74 | 1624 |
| 803463 | N/A | N/A | 32534 | 32553 | TCCTTGAGAGCAGCCCCTGT | 76 | 1625 |
| 803464 | N/A | N/A | 32577 | 32596 | ATTCGAGAACAGCGATTCCC | 100 | 1626 |
| 803465 | N/A | N/A | 32857 | 32876 | ACTGAACAAAGACATCAGGG | 36 | 1627 |
| 803466 | N/A | N/A | 32987 | 33006 | ATGAACGAGCTACTCAAGTT | 79 | 1628 |
| 803467 | N/A | N/A | 32997 | 33016 | AAGAAAGTTGATGAACGAGC | 48 | 1629 |
| 803468 | N/A | N/A | 33091 | 33110 | CCTGCCAATGTAGCCATTTT | 40 | 1630 |
| 803469 | N/A | N/A | 33163 | 33182 | GAATAGGAAAATGTCACAC | 39 | 1631 |
| 803470 | N/A | N/A | 33422 | 33441 | GTCTTACTCAATAGTCACCT | 25 | 1632 |
| 803471 | N/A | N/A | 33499 | 33518 | TCTTGATCTCATCCACTCCA | 44 | 1633 |
| 803472 | N/A | N/A | 35580 | 35599 | CAAGTGTCTTATGTTTTTCT | 42 | 1634 |
| 803473 | N/A | N/A | 35803 | 35822 | GATTTTATCTTTTATAACTT | 75 | 1635 |
| 803474 | N/A | N/A | 36736 | 36755 | TCTGTTTACTTATCAGTCTC | 77 | 1636 |
| 803475 | N/A | N/A | 37002 | 37021 | GCAGTAGGTACTATGAACTT | 36 | 1637 |
| 803476 | N/A | N/A | 38011 | 38030 | CTTGAACTCAGGTCATGGCA | 69 | 1638 |
| 803477 | N/A | N/A | 38572 | 38591 | CTCACCCCCGACCATGTGCA | 71 | 1639 |
| 803478 | N/A | N/A | 38768 | 38787 | CACAATGCTATTGTCTTTAG | 72 | 1640 |
| 803479 | N/A | N/A | 39901 | 39920 | CATAATGTACATCTTTGCCA | 59 | 1641 |
| 803480 | N/A | N/A | 40030 | 40049 | AATGTCTATATAACAAGTTA | 80 | 1642 |
| 803481 | N/A | N/A | 40156 | 40175 | TATATCCCTTCTTAAAGAAT | 94 | 1643 |
| 803482 | N/A | N/A | 40684 | 40703 | CGTGTGGACTGTAAATTTTT | 91 | 1644 |
| 803483 | N/A | N/A | 40840 | 40859 | CATCATGCTACATGTAATGG | 59 | 1645 |
| 803484 | N/A | N/A | 41078 | 41097 | TGCTGGGAATACTATGGTAA | 64 | 1646 |
| 803485 | N/A | N/A | 41108 | 41127 | ATTCCAATTACATGCCAAGG | 49 | 1647 |
| 803486 | N/A | N/A | 41173 | 41192 | ATCTGCATTAATGCAAACTG | 71 | 1648 |
| 803487 | N/A | N/A | 41893 | 41912 | ATTCTTCTGGCATGCCTAAA | 75 | 1649 |
| 803488 | N/A | N/A | 42134 | 42153 | TCATCTTATGTCTCTAACCA | 68 | 1650 |
| 803489 | N/A | N/A | 44968 | 44987 | TACTTTGCTGAGTACCATCC | 54 | 1651 |
| 803490 | N/A | N/A | 45375 | 45394 | AGGAAGTAACCATGTCCTCA | 38 | 1652 |
| 803491 | N/A | N/A | 45376 | 45395 | AAGGAAGTAACCATGTCCTC | 58 | 1653 |
| 803492 | N/A | N/A | 45377 | 45396 | AAAGGAAGTAACCATGTCCT | 57 | 1654 |
| 803493 | N/A | N/A | 45378 | 45397 | AAAAGGAAGTAACCATGTCC | 93 | 1655 |
| 803494 | N/A | N/A | 45379 | 45398 | TAAAAGGAAGTAACCATGTC | 92 | 1656 |
| 803495 | N/A | N/A | 45381 | 45400 | ATTAAAAGGAAGTAACCATG | 78 | 1657 |
| 803496 | N/A | N/A | 45382 | 45401 | TATTAAAAGGAAGTAACCAT | 90 | 1658 |

TABLE 21-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803497 | N/A | N/A | 45383 | 45402 | GTATTAAAAGGAAGTAACCA | 86 | 1659 |
| 803498 | N/A | N/A | 45384 | 45403 | GGTATTAAAAGGAAGTAACC | 34 | 1660 |
| 803499 | N/A | N/A | 45385 | 45404 | AGGTATTAAAAGGAAGTAAC | 50 | 1661 |
| 803500 | N/A | N/A | 46126 | 46145 | TATGTATCCAAACATGGATT | 71 | 1662 |
| 803501 | N/A | N/A | 46232 | 46251 | GGTGACAAAGTCTTCATCTG | 58 | 1663 |
| 803502 | N/A | N/A | 46931 | 46950 | TTTATTTGAGTCTATTTCCT | 79 | 1664 |
| 803503 | N/A | N/A | 48097 | 48116 | GGGTGCATAGTCTGTAGGTA | 32 | 1665 |
| 803504 | N/A | N/A | 48768 | 48787 | GGATTTCAAGAGAAAAAATC | 93 | 1666 |
| 803505 | N/A | N/A | 48918 | 48937 | ATATCTTTACCATGTATATG | 88 | 1667 |
| 803506 | N/A | N/A | 49003 | 49022 | TCCAAACTCAGAATGCACCA | 42 | 1668 |
| 803507 | N/A | N/A | 49316 | 49335 | GTCTATGAGTAATGGCATGG | 47 | 1669 |
| 803508 | N/A | N/A | 49674 | 49693 | GGATTAAAATCAATTTATCA | 80 | 1670 |
| 803509 | N/A | N/A | 50436 | 50455 | AATTTCTTTTGGCTTGATAC | 89 | 1671 |
| 803510 | N/A | N/A | 51368 | 51387 | TTCAAATTATGCGAATCTGA | 66 | 1672 |
| 803511 | N/A | N/A | 51478 | 51497 | TTGGACATCATTTCATTTAT | 48 | 1673 |
| 803512 | N/A | N/A | 52070 | 52089 | ACCTTAAAAGCCCAGGATCT | 85 | 1674 |
| 803513 | N/A | N/A | 52149 | 52168 | ACTTTAAAGATGCAGAAATA | 80 | 1675 |
| 803514 | N/A | N/A | 52150 | 52169 | AACTTTAAAGATGCAGAAAT | 92 | 1676 |
| 803515 | N/A | N/A | 52151 | 52170 | AAACTTTAAAGATGCAGAAA | 111 | 1677 |
| 803516 | N/A | N/A | 52152 | 52171 | CAAACTTTAAAGATGCAGAA | 63 | 1678 |
| 803517 | N/A | N/A | 52153 | 52172 | CCAAACTTTAAAGATGCAGA | 28 | 1679 |
| 803518 | N/A | N/A | 52155 | 52174 | TGCCAAACTTTAAAGATGCA | 40 | 1680 |
| 803519 | N/A | N/A | 52156 | 52175 | TTGCCAAACTTTAAAGATGC | 30 | 1681 |
| 803520 | N/A | N/A | 52157 | 52176 | TTTGCCAAACTTTAAAGATG | 63 | 1682 |
| 803521 | N/A | N/A | 52158 | 52177 | GTTTGCCAAACTTTAAAGAT | 50 | 1683 |
| 803522 | N/A | N/A | 52159 | 52178 | GGTTTGCCAAACTTTAAAGA | 39 | 1684 |
| 803523 | N/A | N/A | 52305 | 52324 | CCAAATATGTTTCACCCCAG | 78 | 1685 |
| 803524 | N/A | N/A | 52501 | 52520 | AGCATTTTTACAATTAAGGA | 59 | 1686 |
| 803525 | N/A | N/A | 53088 | 53107 | CATACTTTAGTCTGTATTTC | 69 | 1687 |
| 803526 | N/A | N/A | 53538 | 53557 | TTATTATATATCATGTTTTA | 83 | 1688 |
| 803527 | N/A | N/A | 53539 | 53558 | GTTATTATATATCATGTTTT | 62 | 1689 |
| 803528 | N/A | N/A | 53540 | 53559 | AGTTATTATATATCATGTTT | 55 | 1690 |
| 803529 | N/A | N/A | 53541 | 53560 | CAGTTATTATATATCATGTT | 55 | 1691 |
| 803530 | N/A | N/A | 53542 | 53561 | ACAGTTATTATATATCATGT | 33 | 1692 |
| 803531 | N/A | N/A | 53544 | 53563 | AGACAGTTATTATATATCAT | 49 | 1693 |
| 803532 | N/A | N/A | 53545 | 53564 | AAGACAGTTATTATATATCA | 64 | 1694 |

TABLE 21-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803533 | N/A | N/A | 53546 | 53565 | AAAGACAGTTATTATATATC | 80 | 1695 |
| 803534 | N/A | N/A | 53547 | 53566 | CAAAGACAGTTATTATATAT | 100 | 1696 |

TABLE 22

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 20 | 235 |
| 780254 | 4111 | 4130 | 86606 | 86625 | GTTTCATTCGGTTATAAGGC | 19 | 235 |
| 803535 | N/A | N/A | 53548 | 53567 | ACAAAGACAGTTATTATATA | 107 | 1697 |
| 803536 | N/A | N/A | 54011 | 54030 | TTCCTGAGTCAGCTGGGCAC | 74 | 1698 |
| 803537 | N/A | N/A | 55467 | 55486 | GTTGAGTGTAGTTGAGAAGC | 49 | 1699 |
| 803538 | N/A | N/A | 55699 | 55718 | AAAGATGCTTGTCTAAAGCC | 51 | 1700 |
| 803539 | N/A | N/A | 55823 | 55842 | AATAAATACTCCCTCTCTCT | 89 | 1701 |
| 803540 | N/A | N/A | 56181 | 56200 | ACTAAAAAGAGTGGAAATGA | 98 | 1702 |
| 803541 | N/A | N/A | 57300 | 57319 | GGCAAACATAGTACTTTATT | 27 | 1703 |
| 803542 | N/A | N/A | 57536 | 57555 | TGTTGCTTGCTTAAAAGAAA | 87 | 1704 |
| 803543 | N/A | N/A | 59667 | 59686 | TACTGCTCACAGATATTTAT | 82 | 1705 |
| 803544 | N/A | N/A | 59986 | 60005 | CTCTTGTCAATGCCCTACAC | 64 | 1706 |
| 803545 | N/A | N/A | 60613 | 60632 | GCAAAAAGGTGTTCATTCTT | 71 | 1707 |
| 803546 | N/A | N/A | 60625 | 60644 | ACTTTTCACCCAGCAAAAG | 106 | 1708 |
| 803547 | N/A | N/A | 60658 | 60677 | ATGCTATTTCTATTACCCCA | 58 | 1709 |
| 803548 | N/A | N/A | 61404 | 61423 | ACCTTCCTCTAAATGTTATG | 87 | 1710 |
| 803549 | N/A | N/A | 61573 | 61592 | CTGTCCTGCCTTTATTTGTG | 86 | 1711 |
| 803550 | N/A | N/A | 62233 | 62252 | TGTTACTTACTTGTTTGTTT | 108 | 1712 |
| 803551 | N/A | N/A | 63413 | 63432 | TTGACTTCATGGTACTAACA | 76 | 1713 |
| 803552 | N/A | N/A | 63832 | 63851 | CAAAGCATTCCACAACATGT | 65 | 1714 |
| 803553 | N/A | N/A | 63953 | 63972 | TGCATTTTCATCAACATTAG | 59 | 1715 |
| 803554 | N/A | N/A | 64097 | 64116 | TTTTTGGCATAAGACTAGTT | 79 | 1716 |
| 803555 | N/A | N/A | 64246 | 64265 | TCTATGTTTTTTTAACTGGG | 40 | 1717 |
| 803556 | N/A | N/A | 64593 | 64612 | CAACAGTAGGAATAGCAATA | 98 | 1718 |
| 803557 | N/A | N/A | 64954 | 64973 | GTTTGCTGAGTGATTCATTA | 59 | 1719 |
| 803558 | N/A | N/A | 66316 | 66335 | AATGGTTTGACTTGAGACAC | 52 | 1720 |

TABLE 22-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803559 | N/A | N/A | 66412 | 66431 | AATTTTCAAAGCGCATGAAA | 92 | 1721 |
| 803560 | N/A | N/A | 66414 | 66433 | TTAATTTTCAAAGCGCATGA | 45 | 1722 |
| 803561 | N/A | N/A | 66415 | 66434 | GTTAATTTTCAAAGCGCATG | 29 | 1723 |
| 803562 | N/A | N/A | 66416 | 66435 | TGTTAATTTTCAAAGCGCAT | 29 | 1724 |
| 803563 | N/A | N/A | 66418 | 66437 | TATGTTAATTTTCAAAGCGC | 32 | 1725 |
| 803564 | N/A | N/A | 66419 | 66438 | ATATGTTAATTTTCAAAGCG | 96 | 1726 |
| 803565 | N/A | N/A | 66420 | 66439 | AATATGTTAATTTTCAAAGC | 90 | 1727 |
| 803566 | N/A | N/A | 66421 | 66440 | GAATATGTTAATTTTCAAAG | 100 | 1728 |
| 803567 | N/A | N/A | 66422 | 66441 | TGAATATGTTAATTTTCAAA | 112 | 1729 |
| 803568 | N/A | N/A | 66672 | 66691 | AGAATGCTCATGTACTGCTG | 43 | 1730 |
| 803569 | N/A | N/A | 66673 | 66692 | CAGAATGCTCATGTACTGCT | 55 | 1731 |
| 803570 | N/A | N/A | 66911 | 66930 | CTGTCACAACTTCTATCTAG | 69 | 1732 |
| 803571 | N/A | N/A | 67066 | 67085 | GTTTCTTAAGTGGGATACAA | 25 | 1733 |
| 803572 | N/A | N/A | 67163 | 67182 | ACTTAAAATGTTTTAGACCT | 88 | 1734 |
| 803573 | N/A | N/A | 68270 | 68289 | AATACCTCAGCAGATGCTGA | 81 | 1735 |
| 803574 | N/A | N/A | 68715 | 68734 | CACATTACTAAAACTGACTT | 78 | 1736 |
| 803575 | N/A | N/A | 68989 | 69008 | AAACCAGTGTTCTAAGCTTC | 64 | 1737 |
| 803576 | N/A | N/A | 70079 | 70098 | AAATGATACTAACTGCAAAC | 85 | 1738 |
| 803577 | N/A | N/A | 70083 | 70102 | AAGAAAATGATACTAACTGC | 78 | 1739 |
| 803578 | N/A | N/A | 70146 | 70165 | TAATCTGCATATGGGTTTCT | 36 | 1740 |
| 803579 | N/A | N/A | 70615 | 70634 | AGATTATTAAATTATCATAA | 112 | 1741 |
| 803580 | N/A | N/A | 71056 | 71075 | TATTTGAATTTCATGTTTCA | 54 | 1742 |
| 803581 | N/A | N/A | 71205 | 71224 | TTTTTATGGAGACCGCTGGA | 77 | 1743 |
| 803582 | N/A | N/A | 71512 | 71531 | GTCCATTCCCTTTGTAAAAT | 53 | 1744 |
| 803583 | N/A | N/A | 71525 | 71544 | TGGAAATTTCACAGTCCATT | 30 | 1745 |
| 803584 | N/A | N/A | 72654 | 72673 | TCATTAACCAAACTACTTTT | 106 | 1746 |
| 803585 | N/A | N/A | 72790 | 72809 | ATTATGAGGATAAAAGAAAA | 125 | 1747 |
| 803586 | N/A | N/A | 72791 | 72810 | AATTATGAGGATAAAAGAAA | 121 | 1748 |
| 803587 | N/A | N/A | 72792 | 72811 | CAATTATGAGGATAAAAGAA | 117 | 1749 |
| 803588 | N/A | N/A | 72793 | 72812 | CCAATTATGAGGATAAAAGA | 92 | 1750 |
| 803589 | N/A | N/A | 72794 | 72813 | CCCAATTATGAGGATAAAAG | 49 | 1751 |
| 803590 | N/A | N/A | 72796 | 72815 | AACCCAATTATGAGGATAAA | 81 | 1752 |
| 803591 | N/A | N/A | 72797 | 72816 | GAACCCAATTATGAGGATAA | 60 | 1753 |
| 803592 | N/A | N/A | 72798 | 72817 | AGAACCCAATTATGAGGATA | 85 | 1754 |
| 803593 | N/A | N/A | 72799 | 72818 | AAGAACCCAATTATGAGGAT | 99 | 1755 |
| 803594 | N/A | N/A | 72800 | 72819 | TAAGAACCCAATTATGAGGA | 89 | 1756 |

TABLE 22-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803595 | N/A | N/A | 73940 | 73959 | AGATCTGTTTCCATTGCCTG | 24 | 1757 |
| 803596 | N/A | N/A | 74241 | 74260 | CTTTAAGTTACACATTATTT | 44 | 1758 |
| 803597 | N/A | N/A | 74300 | 74319 | CAAACTATGTTATACTTTAA | 92 | 1759 |
| 803598 | N/A | N/A | 76344 | 76363 | ACTCTTCAGAGTCTGAAAAG | 79 | 1760 |
| 803599 | N/A | N/A | 76345 | 76364 | AACTCTTCAGAGTCTGAAAA | 71 | 1761 |
| 803600 | N/A | N/A | 76346 | 76365 | AAACTCTTCAGAGTCTGAAA | 71 | 1762 |
| 803601 | N/A | N/A | 76347 | 76366 | CAAACTCTTCAGAGTCTGAA | 67 | 1763 |
| 803602 | N/A | N/A | 76348 | 76367 | TCAAACTCTTCAGAGTCTGA | 62 | 1764 |
| 803603 | N/A | N/A | 76350 | 76369 | TGTCAAACTCTTCAGAGTCT | 20 | 1765 |
| 803604 | N/A | N/A | 76351 | 76370 | GTGTCAAACTCTTCAGAGTC | 16 | 1766 |
| 803605 | N/A | N/A | 77606 | 77625 | ATAGTTGGGAACGAATAGTA | 61 | 1767 |
| 803606 | N/A | N/A | 77607 | 77626 | TATAGTTGGGAACGAATAGT | 89 | 1768 |
| 803607 | N/A | N/A | 77608 | 77627 | TTATAGTTGGGAACGAATAG | 94 | 1769 |
| 803608 | N/A | N/A | 77609 | 77628 | CTTATAGTTGGGAACGAATA | 72 | 1770 |
| 803609 | N/A | N/A | 77610 | 77629 | TCTTATAGTTGGGAACGAAT | 65 | 1771 |
| 803610 | N/A | N/A | 77612 | 77631 | TGTCTTATAGTTGGGAACGA | 36 | 1772 |
| 803611 | N/A | N/A | 77613 | 77632 | ATGTCTTATAGTTGGGAACG | 32 | 1773 |

TABLE 23

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 12 | 235 |
| 780254 | 4111 | 4130 | 86606 | 86625 | GTTTCATTCGGTTATAAGGC | 11 | 235 |
| 780617 | N/A | N/A | 81581 87838 | 81600 87857 | GTTTGAAGGAATAGCTGACA | 35 | 667 |
| 780618 | N/A | N/A | 81584 87841 | 81603 87860 | AGTGTTTGAAGGAATAGCTG | 25 | 668 |
| 780619 | N/A | N/A | 81587 87844 | 81606 87863 | CATAGTGTTTGAAGGAATAG | 62 | 669 |
| 780620 | N/A | N/A | 81590 87847 | 81609 87866 | AGCCATAGTGTTTGAAGGAA | 11 | 670 |
| 780621 | N/A | N/A | 81593 87850 | 81612 87869 | AAAAGCCATAGTGTTTGAAG | 55 | 671 |
| 780622 | N/A | N/A | 81596 87853 | 81615 87872 | CTAAAAGCCATAGTGTTTG | 69 | 672 |

TABLE 23-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780623 | N/A | N/A | 81599 87856 | 81618 87875 | ATTCTAAAAGCCATAGTGT | 45 12 | 673 674 |
| 780624 | N/A | N/A | 81630 87887 | 81649 87906 | GCAGCATCATGCAAGCAGCA | | |
| 780625 | N/A | N/A | 81633 87890 | 81652 87909 | ATTGCAGCATCATGCAAGCA | 40 | 675 |
| 803612 | N/A | N/A | 77614 | 77633 | AATGTCTTATAGTTGGGAAC | 36 | 1774 |
| 803613 | N/A | N/A | 77615 | 77634 | GAATGTCTTATAGTTGGGAA | 45 | 1775 |
| 803614 | N/A | N/A | 77616 | 77635 | AGAATGTCTTATAGTTGGGA | 30 | 1776 |
| 803615 | N/A | N/A | 78807 | 78826 | TAAGGACAGAGACCGAGTTT | 58 | 1777 |
| 803616 | N/A | N/A | 79332 | 79351 | CATTTACATGGGATTATTTT | 56 | 1778 |
| 803617 | N/A | N/A | 79675 | 79694 | ATAGCTATTATACCTCACCT | 52 | 1779 |
| 803618 | N/A | N/A | 79976 | 79995 | ATTGTTAAGAAGGAAATGCA | 70 | 1780 |
| 803619 | N/A | N/A | 80327 | 80346 | ACTCTGGTATATTTTATGAT | N/A | 1781 |
| 803620 | N/A | N/A | 80378 | 80397 | AGAGATTGGGAAACATTCAG | 38 | 1782 |
| 803621 | N/A | N/A | 80523 | 80542 | TATAGCAAAACAACTATGAA | 84 | 1783 |
| 803622 | N/A | N/A | 81353 | 81372 | CCCCAAAATTTCACTCAAAC | 55 | 1784 |
| 803623 | N/A | N/A | 81582 87839 | 81601 87858 | TGTTTGAAGGAATAGCTGAC | 50 | 1785 |
| 803624 | N/A | N/A | 81583 87840 | 81602 87859 | GTGTTTGAAGGAATAGCTGA | 39 | 1786 |
| 803625 | N/A | N/A | 81585 87842 | 81604 87861 | TAGTGTTTGAAGGAATAGCT | 48 | 1787 |
| 803626 | N/A | N/A | 81586 87843 | 81605 87862 | ATAGTGTTTGAAGGAATAGC | 48 | 1788 |
| 803627 | N/A | N/A | 81588 87845 | 81607 87864 | CCATAGTGTTTGAAGGAATA | 26 | 1789 |
| 803628 | N/A | N/A | 81589 87846 | 81608 87865 | GCCATAGTGTTTGAAGGAAT | 12 | 1790 |
| 803629 | N/A | N/A | 81591 87848 | 81610 87867 | AAGCCATAGTGTTTGAAGGA | 19 | 1791 |
| 803630 | N/A | N/A | 81592 87849 | 81611 87868 | AAAGCCATAGTGTTTGAAGG | 34 | 1792 |
| 803631 | N/A | N/A | 81594 87851 | 81613 87870 | AAAAAGCCATAGTGTTTGAA | 56 | 1793 |
| 803632 | N/A | N/A | 81595 87852 | 81614 87871 | TAAAAGCCATAGTGTTTGA | 76 | 1794 |
| 803633 | N/A | N/A | 81597 87854 | 81616 87873 | TCTAAAAGCCATAGTGTTT | 58 | 1795 |
| 803634 | N/A | N/A | 81598 87855 | 81617 87874 | TTCTAAAAGCCATAGTGTT | 71 | 1796 |
| 803635 | N/A | N/A | 81625 | 81644 | ATCATGCAAGCAGCATTTTA | 63 | 1797 |
| 803636 | N/A | N/A | 81626 | 81645 | CATCATGCAAGCAGCATTTT | 82 | 1798 |

TABLE 23-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803637 | N/A | N/A | 81627 | 81646 | GCATCATGCAAGCAGCATTT | 23 | 1799 |
| 803638 | N/A | N/A | 81628 | 81647 | AGCATCATGCAAGCAGCATT | 25 | 1800 |
| 803639 | N/A | N/A | 81629 | 81648 | CAGCATCATGCAAGCAGCAT | 34 | 1801 |
| 803640 | N/A | N/A | 81631 | 81650 | TGCAGCATCATGCAAGCAGC | 16 | 1802 |
| 803641 | N/A | N/A | 81632 87888 | 81651 87907 | TTGCAGCATCATGCAAGCAG | 31 | 1803 |
| 803642 | N/A | N/A | 81634 87889 | 81653 87908 | CATTGCAGCATCATGCAAGC | 44 | 1804 |
| 803643 | N/A | N/A | 81635 87891 | 81654 87910 | TCATTGCAGCATCATGCAAG | 43 | 1805 |
| | | | 87892 | 87911 | | | |
| 803644 | N/A | N/A | 81822 | 81841 | GGAGATAATAACAGTGGCTA | 48 | 1806 |
| 803645 | N/A | N/A | 82500 | 82519 | GTGGAAGTATTAAGGCTACT | 14 | 1807 |
| 803646 | N/A | N/A | 82501 | 82520 | AGTGGAAGTATTAAGGCTAC | 23 | 1808 |
| 803647 | N/A | N/A | 82502 | 82521 | TAGTGGAAGTATTAAGGCTA | 20 | 1809 |
| 803648 | N/A | N/A | 82503 | 82522 | TTAGTGGAAGTATTAAGGCT | 36 | 1810 |
| 803649 | N/A | N/A | 82504 | 82523 | TTTAGTGGAAGTATTAAGGC | 43 | 1811 |
| 803650 | N/A | N/A | 82506 | 82525 | TGTTTAGTGGAAGTATTAAG | 32 | 1812 |
| 803651 | N/A | N/A | 82507 | 82526 | TTGTTTAGTGGAAGTATTAA | 81 | 1813 |
| 803652 | N/A | N/A | 82508 | 82527 | ATTGTTTAGTGGAAGTATTA | 60 | 1814 |
| 803653 | N/A | N/A | 82509 | 82528 | TATTGTTTAGTGGAAGTATT | 62 | 1815 |
| 803654 | N/A | N/A | 82510 | 82529 | TTATTGTTTAGTGGAAGTAT | 36 | 1816 |
| 803655 | N/A | N/A | 82697 | 82716 | TTGTCATAGTTAAGTAACAG | 20 | 1817 |
| 803656 | N/A | N/A | 83102 | 83121 | AAACAAGTAATACAGTATAC | 83 | 1818 |
| 803657 | N/A | N/A | 83213 | 83232 | ATTTCAGATTTACAACAGAG | 70 | 1819 |
| 803658 | N/A | N/A | 85777 | 85796 | TGTTAAAGCTTGATAATAGG | 49 | 1820 |
| 803659 | N/A | N/A | 86988 | 87007 | AGCACCAAATTGTTCCTAAC | 62 | 1821 |
| 803660 | N/A | N/A | 89783 | 89802 | AGCACACATAATCTATATAA | 34 | 1822 |
| 803661 | N/A | N/A | 89916 | 89935 | TACCATCTATCATCAATAAA | 26 | 1823 |
| 803662 | N/A | N/A | 90146 | 90165 | TTCTCTGACAACAATGACAA | 62 | 1824 |
| 803663 | N/A | N/A | 90678 | 90697 | TGTCTGCACAGACACCTGTT | 87 | 1825 |
| 803664 | N/A | N/A | 91038 | 91057 | GTATCTCTTAACCCAGAGAA | 37 | 1826 |
| 803665 | N/A | N/A | 91039 | 91058 | TGTATCTCTTAACCCAGAGA | 17 | 1827 |
| 803666 | N/A | N/A | 91040 | 91059 | ATGTATCTCTTAACCCAGAG | 24 | 1828 |
| 803667 | N/A | N/A | 91041 | 91060 | CATGTATCTCTTAACCCAGA | 36 | 1829 |
| 803668 | N/A | N/A | 91042 | 91061 | TCATGTATCTCTTAACCCAG | 37 | 1830 |
| 803669 | N/A | N/A | 91044 | 91063 | TTTCATGTATCTCTTAACCC | 26 | 1831 |
| 803670 | N/A | N/A | 91045 | 91064 | TTTTCATGTATCTCTTAACC | 58 | 1832 |
| 803671 | N/A | N/A | 91046 | 91065 | GTTTTCATGTATCTCTTAAC | 20 | 1833 |
| 803672 | N/A | N/A | 91047 | 91066 | TGTTTTCATGTATCTCTTAA | 36 | 1834 |

TABLE 23-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803673 | N/A | N/A | 91048 | 91067 | CTGTTTTCATGTATCTCTTA | 21 | 1835 |
| 803674 | N/A | N/A | 91144 | 91163 | AAATTAACTTGGTCTTTTTC | 68 | 1836 |
| 803675 | N/A | N/A | 91456 | 91475 | TCTGTTGCTCTTAGAATCTA | 23 | 1837 |
| 803676 | N/A | N/A | 91530 | 91549 | ATGGAACCTTGAACTTGGGA | 25 | 1838 |
| 803677 | N/A | N/A | 92329 | 92348 | GATTCAGAAACACTTTTATA | 59 | 1839 |
| 803678 | N/A | N/A | 92773 | 92792 | AAGTTGCTTTGAGAATTTTC | 48 | 1840 |
| 803679 | N/A | N/A | 93235 | 93254 | AAATCTAGTCCAACTTCCTC | 78 | 1841 |

TABLE 24

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 18 | 235 |
| 780254 | 4111 | 4130 | 86606 | 86625 | GTTTCATTCGGTTATAAGGC | 20 | 235 |
| 803680 | N/A | N/A | 93932 | 93951 | ACTCATTGGTAATGGATTAT | 24 | 1842 |
| 803681 | N/A | N/A | 94454 | 94473 | TTGCAATGTTTCAATATGCT | 53 | 1843 |
| 803682 | N/A | N/A | 94455 | 94474 | ATTGCAATGTTTCAATATGC | 26 | 1844 |
| 803683 | N/A | N/A | 94456 | 94475 | GATTGCAATGTTTCAATATG | 58 | 1845 |
| 803684 | N/A | N/A | 94457 | 94476 | TGATTGCAATGTTTCAATAT | 65 | 1846 |
| 803685 | N/A | N/A | 94458 | 94477 | CTGATTGCAATGTTTCAATA | 53 | 1847 |
| 803686 | N/A | N/A | 94460 | 94479 | TGCTGATTGCAATGTTTCAA | 24 | 1848 |
| 803687 | N/A | N/A | 94461 | 94480 | TTGCTGATTGCAATGTTTCA | 57 | 1849 |
| 803688 | N/A | N/A | 94462 | 94481 | ATTGCTGATTGCAATGTTTC | 59 | 1850 |
| 803689 | N/A | N/A | 94463 | 94482 | AATTGCTGATTGCAATGTTT | 54 | 1851 |
| 803690 | N/A | N/A | 94464 | 94483 | TAATTGCTGATTGCAATGTT | 75 | 1852 |
| 803691 | N/A | N/A | 95362 | 95381 | AATCGGAAATTTAAATTATC | 104 | 1853 |
| 803692 | N/A | N/A | 95619 | 95638 | TTAGTGACCTAACAGCTCGG | 64 | 1854 |
| 803693 | N/A | N/A | 97048 | 97067 | GTACAGTATTTATTGAATCA | 27 | 1855 |
| 803694 | N/A | N/A | 97142 | 97161 | ATTTATGCTATCATGTAGTT | 71 | 1856 |
| 803695 | N/A | N/A | 97748 | 97767 | AATAATATATTCCCAGGAAA | 90 | 1857 |
| 803696 | N/A | N/A | 97935 | 97954 | TAGCAACCATGTGGCCTAGA | 59 | 1858 |
| 803697 | N/A | N/A | 98088 | 98107 | ACTGTCAAAATCTGAAAGAT | 92 | 1859 |
| 803698 | N/A | N/A | 98337 | 98356 | AGTTAGTTTGACAATTAAAA | 72 | 1860 |

TABLE 24-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803699 | N/A | N/A | 98486 | 98505 | AGTAACTATACACATAAAGT | 99 | 1861 |
| 803700 | N/A | N/A | 99619 | 99638 | CACCGGATTTGCTCTTTTTT | 30 | 1862 |
| 803701 | N/A | N/A | 100073 | 100092 | AATCTACTGCACACAACACA | 89 | 1863 |
| 803702 | N/A | N/A | 100118 | 100137 | AATGGAGCCATTAATTATTA | 95 | 1864 |
| 803703 | N/A | N/A | 100281 | 100300 | ATTTCCTTACCTTTTCTACA | 103 | 1865 |
| 803704 | N/A | N/A | 100353 | 100372 | GCTTTAAGGTAAAGTTTTTT | 33 | 1866 |
| 803705 | N/A | N/A | 100816 | 100835 | GCCAGCATTCAAACCCTCAA | 39 | 1867 |
| 803706 | N/A | N/A | 102479 | 102498 | ATGAGAGTAGATTTTAATAG | 85 | 1868 |
| 803707 | N/A | N/A | 102841 | 102860 | CTGAGTTCCAAAGCATTTAA | 80 | 1869 |
| 803708 | N/A | N/A | 103029 | 103048 | CACATTTTAATGCAGGAAAA | 97 | 1870 |
| 803709 | N/A | N/A | 105168 | 105187 | TGGATATAAGTGAATACACA | 71 | 1871 |
| 803710 | N/A | N/A | 105655 | 105674 | ATAGTGGCCCCTAAATCCTT | 83 | 1872 |
| 803711 | N/A | N/A | 105656 | 105675 | TATAGTGGCCCCTAAATCCT | 79 | 1873 |
| 803712 | N/A | N/A | 105657 | 105676 | ATATAGTGGCCCCTAAATCC | 73 | 1874 |
| 803713 | N/A | N/A | 105658 | 105677 | CATATAGTGGCCCCTAAATC | 88 | 1875 |
| 803714 | N/A | N/A | 105659 | 105678 | TCATATAGTGGCCCCTAAAT | 80 | 1876 |
| 803715 | N/A | N/A | 105661 | 105680 | AGTCATATAGTGGCCCCTAA | 46 | 1877 |
| 803716 | N/A | N/A | 105662 | 105681 | TAGTCATATAGTGGCCCCTA | 58 | 1878 |
| 803717 | N/A | N/A | 105663 | 105682 | ATAGTCATATAGTGGCCCCT | 57 | 1879 |
| 803718 | N/A | N/A | 105664 | 105683 | CATAGTCATATAGTGGCCCC | 49 | 1880 |
| 803719 | N/A | N/A | 105665 | 105684 | CCATAGTCATATAGTGGCCC | 35 | 1881 |
| 803720 | N/A | N/A | 105789 | 105808 | CTTCCAACTCATTCTCTCTC | 75 | 1882 |
| 803721 | N/A | N/A | 105839 | 105858 | GTGGCCTCAGAGCTTTCTGC | 62 | 1883 |
| 803722 | N/A | N/A | 105902 | 105921 | TCCACTGTGTAGCCTCATTT | 103 | 1884 |
| 803723 | N/A | N/A | 106062 | 106081 | AAGCCACATTTATTACCTTT | 49 | 1885 |
| 803724 | N/A | N/A | 106724 | 106743 | GAGAAATAACACAAAACTTT | 101 | 1886 |
| 803725 | N/A | N/A | 106922 | 106941 | GGCACTGAAAAGTCCCAAGT | 28 | 1887 |
| 803726 | N/A | N/A | 107295 | 107314 | AGTAGGAAATAGGATAAGCA | 79 | 1888 |
| 803727 | N/A | N/A | 108334 | 108353 | TTAACATGTAAGGACTGAAA | 97 | 1889 |
| 803728 | N/A | N/A | 108377 | 108396 | TGATGACATATCCACCACAT | 84 | 1890 |
| 803729 | N/A | N/A | 108774 | 108793 | TTTAGCTTACTACTATATAT | 91 | 1891 |
| 803730 | N/A | N/A | 109150 | 109169 | TAATGCAAGTAATACAAAAA | 102 | 1892 |
| 803731 | N/A | N/A | 109281 | 109300 | TTCTTTAACAATCAATAGAG | 79 | 1893 |
| 803732 | N/A | N/A | 109893 | 109912 | TATGGATGAAAAGTGAACAT | 91 | 1894 |
| 803733 | N/A | N/A | 110855 | 110874 | GAAATTACCTACACATTAAA | 103 | 1895 |
| 803734 | N/A | N/A | 110955 | 110974 | GACATTTTAATGTACTAAT | 63 | 1896 |

TABLE 24-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803735 | N/A | N/A | 111205 | 111224 | AATTTTCTATCCTGGAAAAG | 95 | 1897 |
| 803736 | N/A | N/A | 111262 | 111281 | AGAAGGAGTTAAGTTAGCTC | 51 | 1898 |
| 803737 | N/A | N/A | 112344 | 112363 | CAGTGTAGTCATACTAACAG | 58 | 1899 |
| 803738 | N/A | N/A | 112345 | 112364 | ACAGTGTAGTCATACTAACA | 54 | 1900 |
| 803739 | N/A | N/A | 112346 | 112365 | CACAGTGTAGTCATACTAAC | 58 | 1901 |
| 803740 | N/A | N/A | 112347 | 112366 | ACACAGTGTAGTCATACTAA | 31 | 1902 |
| 803741 | N/A | N/A | 112348 | 112367 | CACACAGTGTAGTCATACTA | 38 | 1903 |
| 803742 | N/A | N/A | 112350 | 112369 | TGCACACAGTGTAGTCATAC | 35 | 1904 |
| 803743 | N/A | N/A | 112351 | 112370 | GTGCACACAGTGTAGTCATA | 30 | 1905 |
| 803744 | N/A | N/A | 112352 | 112371 | AGTGCACACAGTGTAGTCAT | 27 | 1906 |
| 803745 | N/A | N/A | 112353 | 112372 | CAGTGCACACAGTGTAGTCA | 19 | 1907 |
| 803746 | N/A | N/A | 112354 | 112373 | ACAGTGCACACAGTGTAGTC | 45 | 1908 |
| 803747 | N/A | N/A | 112629 | 112648 | CTTGCTTTATGGTAAGAATG | 46 | 1909 |
| 803748 | N/A | N/A | 113302 | 113321 | CAAGTCTGGATCACACTTGT | 71 | 1910 |
| 803749 | N/A | N/A | 113398 | 113417 | AAAATTTGATCAGGGAAATG | 102 | 1911 |
| 803750 | N/A | N/A | 113772 | 113791 | GTGGAATAGTGATGAATCCC | 35 | 1912 |
| 803751 | N/A | N/A | 113824 | 113843 | AGACTATTTAAAAAATGGGA | 77 | 1913 |
| 803752 | N/A | N/A | 114604 | 114623 | CACAGTAATTCTGAAGGCTT | 64 | 1914 |
| 803753 | N/A | N/A | 114621 | 114640 | CCTTCCCCTACTGTCAACAC | 80 | 1915 |
| 803754 | N/A | N/A | 114658 | 114677 | CCCCAGGCACTGTTTTCCTT | 92 | 1916 |
| 803755 | N/A | N/A | 115071 | 115090 | GTTTCAGAGAACTAGAATAA | 65 | 1917 |
| 803756 | N/A | N/A | 115110 | 115129 | ACTTCATCAGAAACTGCTGG | 48 | 1918 |

TABLE 25

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 24 | 235 |
| 780254 | 4111 | 4130 | 86606 | 86625 | GTTTCATTCGGTTATAAGGC | 26 | 235 |
| 803757 | N/A | N/A | 117459 | 117478 | AAAATTCTGATTTCCAACTC | 94 | 1919 |
| 803758 | N/A | N/A | 118016 | 118035 | GTATGTTAAATAAGAATTGA | 99 | 1920 |
| 803759 | N/A | N/A | 118692 | 118711 | CAATGTGATGCTTGCATTTT | 87 | 1921 |
| 803760 | N/A | N/A | 118987 | 119006 | TGACACCAAATTAGTCATTT | 55 | 1922 |

TABLE 25-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803761 | N/A | N/A | 119091 | 119110 | TGTACTCAAACATGTATATA | 75 | 1923 |
| 803762 | N/A | N/A | 119108 | 119127 | GGTCACGGCCAGCCCCTGT | 95 | 1924 |
| 803763 | N/A | N/A | 119608 | 119627 | AACATACACTTTGAAGTGTT | 62 | 1925 |
| 803764 | N/A | N/A | 119902 | 119921 | GTTTAGGAGAGACTATAGAA | 73 | 1926 |
| 803765 | N/A | N/A | 119903 | 119922 | GGTTTAGGAGAGACTATAGA | 42 | 1927 |
| 803766 | N/A | N/A | 119904 | 119923 | TGGTTTAGGAGAGACTATAG | 43 | 1928 |
| 803767 | N/A | N/A | 119905 | 119924 | ATGGTTTAGGAGAGACTATA | 43 | 1929 |
| 803768 | N/A | N/A | 119906 | 119925 | TATGGTTTAGGAGAGACTAT | 49 | 1930 |
| 803769 | N/A | N/A | 119908 | 119927 | CATATGGTTTAGGAGAGACT | 28 | 1931 |
| 803770 | N/A | N/A | 119909 | 119928 | GCATATGGTTTAGGAGAGAC | 8 | 1932 |
| 803771 | N/A | N/A | 119910 | 119929 | TGCATATGGTTTAGGAGAGA | 14 | 1933 |
| 803772 | N/A | N/A | 119911 | 119930 | TTGCATATGGTTTAGGAGAG | 40 | 1934 |
| 803773 | N/A | N/A | 119912 | 119931 | GTTGCATATGGTTTAGGAGA | 21 | 1935 |
| 803774 | N/A | N/A | 120040 | 120059 | TCTATGGAATTTCATCCTTT | 62 | 1936 |
| 803775 | N/A | N/A | 120380 | 120399 | CAGCAAAACCAGGAAGTCAG | 75 | 1937 |
| 803776 | N/A | N/A | 121866 | 121885 | GTATTGTTGCCAAATGAATG | 50 | 1938 |
| 803777 | N/A | N/A | 121867 | 121886 | TGTATTGTTGCCAAATGAAT | 64 | 1939 |
| 803778 | N/A | N/A | 121868 | 121887 | ATGTATTGTTGCCAAATGAA | 66 | 1940 |
| 803779 | N/A | N/A | 121869 | 121888 | AATGTATTGTTGCCAAATGA | 77 | 1941 |
| 803780 | N/A | N/A | 121870 | 121889 | CAATGTATTGTTGCCAAATG | 56 | 1942 |
| 803781 | N/A | N/A | 121872 | 121891 | TTCAATGTATTGTTGCCAAA | 49 | 1943 |
| 803782 | N/A | N/A | 121873 | 121892 | GTTCAATGTATTGTTGCCAA | 21 | 1944 |
| 803783 | N/A | N/A | 121874 | 121893 | TGTTCAATGTATTGTTGCCA | 43 | 1945 |
| 803784 | N/A | N/A | 121875 | 121894 | ATGTTCAATGTATTGTTGCC | 38 | 1946 |
| 803785 | N/A | N/A | 121876 | 121895 | AATGTTCAATGTATTGTTGC | 57 | 1947 |
| 803786 | N/A | N/A | 122268 | 122287 | CACATCCTTTTACAATAGTT | 46 | 1948 |
| 803787 | N/A | N/A | 123076 | 123095 | AGGATGGAGACATCGAATTT | 67 | 1949 |
| 803788 | N/A | N/A | 123077 | 123096 | AAGGATGGAGACATCGAATT | 78 | 1950 |
| 803789 | N/A | N/A | 123078 | 123097 | GAAGGATGGAGACATCGAAT | 45 | 1951 |
| 803790 | N/A | N/A | 123079 | 123098 | GGAAGGATGGAGACATCGAA | 46 | 1952 |
| 803791 | N/A | N/A | 123080 | 123099 | TGGAAGGATGGAGACATCGA | 67 | 1953 |
| 803792 | N/A | N/A | 123082 | 123101 | GTTGGAAGGATGGAGACATC | 65 | 1954 |
| 803793 | N/A | N/A | 123083 | 123102 | AGTTGGAAGGATGGAGACAT | 54 | 1955 |
| 803794 | N/A | N/A | 123084 | 123103 | GAGTTGGAAGGATGGAGACA | 67 | 1956 |
| 803795 | N/A | N/A | 123085 | 123104 | AGAGTTGGAAGGATGGAGAC | 82 | 1957 |
| 803796 | N/A | N/A | 123086 | 123105 | AAGAGTTGGAAGGATGGAGA | 99 | 1958 |

TABLE 25-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803797 | N/A | N/A | 124014 | 124033 | TGGATAGACAGAAAGTTATC | 89 | 1959 |
| 803798 | N/A | N/A | 124460 | 124479 | TCCAGGACAGTGTTTTAAAA | 57 | 1960 |
| 803799 | N/A | N/A | 125043 | 125062 | AATCTTCATTGTAGAGAAAA | 96 | 1961 |
| 803800 | N/A | N/A | 125214 | 125233 | GCGGATTTTTAAAAAGCCT | 44 | 1962 |
| 803801 | N/A | N/A | 126287 | 126306 | TAAAAAGAGACCCAAATAAC | 108 | 1963 |
| 803802 | N/A | N/A | 126714 | 126733 | TTTAATTCTGTCTCTGTGTG | 88 | 1964 |
| 803803 | N/A | N/A | 127951 | 127970 | GCTTGAGAAGACCTAAGTAA | 72 | 1965 |
| 803804 | N/A | N/A | 128819 | 128838 | GATGGTAACCTAAATTAAAA | 87 | 1966 |
| 803805 | N/A | N/A | 129120 | 129139 | AGAGCTGTGACATGGCCACC | 74 | 1967 |
| 803806 | N/A | N/A | 129202 | 129221 | TCTCTAGATTCTGTTTTTGA | 97 | 1968 |
| 803807 | N/A | N/A | 129512 | 129531 | CTGGAACCCAACTAGATCAC | 78 | 1969 |
| 803808 | N/A | N/A | 129985 | 130004 | TGATTCTAAAGCAAAACACA | 96 | 1970 |
| 803809 | N/A | N/A | 130212 | 130231 | CTTGCCTGGCAGTGGGAAAA | 120 | 1971 |
| 803810 | N/A | N/A | 130229 | 130248 | AATGAAAGACTGGCTCCCTT | 103 | 1972 |
| 803811 | N/A | N/A | 130358 | 130377 | GTTCAGAGATGTGCTATTTA | 61 | 1973 |
| 803812 | N/A | N/A | 130530 | 130549 | GCACAATATTTATCTTCAGG | 44 | 1974 |
| 803813 | N/A | N/A | 130540 | 130559 | TAATGTTGAGGCACAATATT | 121 | 1975 |
| 803814 | N/A | N/A | 132624 | 132643 | AAAGATCTGTAATTTCCCCA | 59 | 1976 |
| 803815 | N/A | N/A | 134408 | 134427 | AGCAATACAAATACAGCATA | 55 | 1977 |
| 803816 | N/A | N/A | 136673 | 136692 | GTAGGTAGACCAATGTAGAG | 73 | 1978 |
| 803817 | N/A | N/A | 137059 | 137078 | ATTAATAAAATACCTAGGAG | 110 | 1979 |
| 803818 | N/A | N/A | 137783 | 137802 | TACTAAGATTACAATGAGTT | 82 | 1980 |
| 803819 | N/A | N/A | 137934 | 137953 | TTCCTACAATCAATACTTAA | 86 | 1981 |
| 803820 | N/A | N/A | 138184 | 138203 | GAACTATGATTTATGCTCTT | 47 | 1982 |
| 803821 | N/A | N/A | 138715 | 138734 | ATTGCATCAGATTGATGTAC | 82 | 1983 |
| 803822 | N/A | N/A | 139321 | 139340 | AAAAATCCTCATTCATGGGA | 66 | 1984 |
| 803823 | N/A | N/A | 139750 | 139769 | TAAAGCATCTATGCTCCAAA | 47 | 1985 |
| 803824 | N/A | N/A | 140044 | 140063 | GCAGACCTAGAACTCCAAAA | 39 | 1986 |
| 803825 | N/A | N/A | 140485 | 140504 | AACAACGAGGAATATGTAAA | 91 | 1987 |
| 803826 | N/A | N/A | 140731 | 140750 | CAAAATAGACCAACCAGTCC | 87 | 1988 |
| 803827 | N/A | N/A | 140958 | 140977 | CATCCAAACATAAACAGAAA | 85 | 1989 |
| 803828 | N/A | N/A | 141091 | 141110 | GTTAGCCTTTTATACCTAGA | 29 | 1990 |
| 803829 | N/A | N/A | 141151 | 141170 | ATCTGTAACTTTTGAATGTT | 77 | 1991 |
| 803830 | N/A | N/A | 142094 | 142113 | GGTCTTGATCCCCACTCCTT | 110 | 1992 |
| 803831 | N/A | N/A | 142406 | 142425 | TATCAAGGAGACCTGTTGGC | 114 | 1993 |

TABLE 25-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803832 | N/A | N/A | 142595 | 142614 | AAGTTTTACATGAAGTCTCA | 92 | 1994 |
| 803833 | N/A | N/A | 144471 | 144490 | AGCTGTTATGGGAACCCAAA | 60 | 1995 |

TABLE 26

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 24 | 222 |
| 803625 | N/A | N/A | 81585 87842 | 81604 87861 | TAGTGTTTGAAGGAATAGCT | 69 | 1787 |
| 876008 | 62 | 81 | 3181 | 3200 | CGTCCGCTGCTCAGGGAACC | 39 | 1996 |
| 876032 | 737 | 756 | 18636 | 18655 | AACGCACTTAACAATATCAT | 33 | 1997 |
| 876056 | 872 | 891 | 21703 | 21722 | ATAGCTTCCACCACAATATT | 71 | 1998 |
| 876080 | 1337 | 1356 | 31053 | 31072 | TTTGATGAAGAATGCATCAG | 83 | 1999 |
| 876104 | 1486 | 1505 | 35433 | 35452 | CACTTTCAGCCACTTCAGGA | 47 | 2000 |
| 876128 | 1728 | 1747 | 41961 | 41980 | AATATCATTCTTGAAACACT | 44 | 2001 |
| 876152 | 2493 | 2512 | 62114 | 62133 | ATCCAGGGCCAGCCTCCTTA | 76 | 2002 |
| 876176 | 3158 | 3177 | 73694 | 73713 | TGAAGCTCCAGCTTTTCAAG | 45 | 2003 |
| 876200 | 3571 | 3590 | 77320 | 77339 | TCTCCACTTTAGGACAAGCC | 35 | 2004 |
| 876224 | 3856 | 3875 | 82201 | 82220 | GATGCAGTTTCTCTACTCTA | 24 | 2005 |
| 876248 | 4319 | 4338 | 87223 | 87242 | GGATGAGTACTATAGAATTC | 41 | 2006 |
| 876272 | 4754 | 4773 | 92177 | 92196 | TTCCGGTCAATTACGGGAAA | 63 | 2007 |
| 876296 | 5075 | 5094 | 98223 | 98242 | ATCTGGAATTTTTCTAGGAG | 49 | 2008 |
| 876320 | 5482 | 5501 | 100471 | 100490 | CAGGAAACCATTCTTCCATG | 44 | 2009 |
| 876344 | 5833 | 5852 | 106524 | 106543 | GTTTATTAAAAATCTTCACA | 76 | 2010 |
| 876368 | 6603 | 6622 | 129748 | 129767 | AATGCTTGCATTCCTGCTGT | 70 | 2011 |
| 876392 | 7223 | 7242 | 141584 | 141603 | TCCACAACAGGGCTATTTTG | 75 | 2012 |
| 876416 | 8192 | 8211 | 146361 | 146380 | AATTCATTTGAATATTTACA | 89 | 2013 |
| 876440 | 9043 | 9062 | 147212 | 147231 | GTTAAAGCATAGCTTCCTTT | 63 | 2014 |
| 876464 | N/A | N/A | 4983 | 5002 | AATGAAGGTGGCCAGAATCA | 125 | 2015 |
| 876488 | N/A | N/A | 7242 | 7261 | AAGTGAGTATTAAAATGTCA | 112 | 2016 |
| 876512 | N/A | N/A | 9238 | 9257 | CAAAATGTAAGTTATCAGAA | 138 | 2017 |
| 876536 | N/A | N/A | 12445 | 12464 | TCAATAATGTTTAGTTAGTT | 85 | 2018 |
| 876560 | N/A | N/A | 15299 | 15318 | ACTATAGTACATGTATCTCA | 68 | 2019 |

TABLE 26-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876584 | N/A | N/A | 17431 | 17450 | TTATACATGACAGCCTGAAG | 121 | 2020 |
| 876608 | N/A | N/A | 19744 | 19763 | AGAACACTTATTACATACCA | 56 | 2021 |
| 876632 | N/A | N/A | 21991 | 22010 | TTTTTGACACTCCTTTTAAA | 93 | 2022 |
| 876656 | N/A | N/A | 25071 | 25090 | ACGATCATTCCTTATTATTC | 52 | 2023 |
| 876680 | N/A | N/A | 27616 | 27635 | GGCACGACAATATTCATTGT | 68 | 2024 |
| 876704 | N/A | N/A | 30008 | 30027 | CAACCTGCTGGCTAGTCACC | 40 | 2025 |
| 876728 | N/A | N/A | 32100 | 32119 | TAATTATACAAAGCTATAAG | 126 | 2026 |
| 876752 | N/A | N/A | 33547 | 33566 | ATAGAACATTTTACACACTA | 63 | 2027 |
| 876776 | N/A | N/A | 35959 | 35978 | AACCGCCAGCTATATAATCT | 73 | 2028 |
| 876800 | N/A | N/A | 38194 | 38213 | AGGTGATAACAGATGTCAGT | 104 | 2029 |
| 876824 | N/A | N/A | 39985 | 40004 | AGTAATAGATTGAAAGAAAC | 90 | 2030 |
| 876848 | N/A | N/A | 42029 | 42048 | TTAATAGTATAAATACAGAA | 119 | 2031 |
| 876872 | N/A | N/A | 45638 | 45657 | CCGACTGCTGAGGTTACACC | 64 | 2032 |
| 876896 | N/A | N/A | 47955 | 47974 | GTGAGGGAGAGGACATAAAG | 99 | 2033 |
| 876920 | N/A | N/A | 49786 | 49805 | TGTATTACATAGGTATGACT | 52 | 2034 |
| 876944 | N/A | N/A | 52148 | 52167 | CTTTAAAGATGCAGAAATAA | 100 | 2035 |
| 876968 | N/A | N/A | 55095 | 55114 | TTACCCGTGCATGCACCTGT | 119 | 2036 |
| 876992 | N/A | N/A | 57336 | 57355 | ATATTAAATACAGTAAGGTT | 115 | 2037 |
| 877016 | N/A | N/A | 60029 | 60048 | CCATTCACTCCTTACTTTGT | 66 | 2038 |
| 877040 | N/A | N/A | 62799 | 62818 | AAAGATAAAAATAGTGTCAG | 91 | 2039 |
| 877064 | N/A | N/A | 65735 | 65754 | CTCAAGTTTTTCCAGATGAT | 55 | 2040 |
| 877088 | N/A | N/A | 67068 | 67087 | AGGTTTCTTAAGTGGGATAC | 40 | 2041 |
| 877112 | N/A | N/A | 70290 | 70309 | GCTTAGAGACAAATTAAGGG | 37 | 2042 |
| 877136 | N/A | N/A | 72623 | 72642 | TTATATATAAATTCGAAAGA | 158 | 2043 |
| 877160 | N/A | N/A | 73942 | 73961 | TCAGATCTGTTTCCATTGCC | 31 | 2044 |
| 877184 | N/A | N/A | 75823 | 75842 | CAATTTCTAATTTTATAATG | 111 | 2045 |
| 877208 | N/A | N/A | 78402 | 78421 | ATTTCCTCTATTATTTCATA | 47 | 2046 |
| 877239 | N/A | N/A | 83094 | 83113 | AATACAGTATACAGGCCAGT | 32 | 2047 |
| 877263 | N/A | N/A | 85311 | 85330 | CATTACCTTTCTTGATTTAT | 85 | 2048 |
| 877287 | N/A | N/A | 88256 | 88275 | TTTCCTTTCCCATCTTCATG | 92 | 2049 |
| 877311 | N/A | N/A | 90591 | 90610 | GAGGACAAAAAATGATCTCT | 70 | 2050 |
| 877335 | N/A | N/A | 92465 | 92484 | CTAAATTTGTTTTCTTATGA | 129 | 2051 |
| 877359 | N/A | N/A | 94743 | 94762 | ACCAGGGAGGCAATATAGAA | 62 | 2052 |
| 877383 | N/A | N/A | 96119 | 96138 | CCACATGGAGAAGCACCAAT | 62 | 2053 |
| 877407 | N/A | N/A | 99047 | 99066 | AAAGTCAATGAAGGTAATCA | 56 | 2054 |
| 877431 | N/A | N/A | 101670 | 101689 | ATTAAGGCAAATACAAAGAT | 127 | 2055 |

TABLE 26-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
| --- | --- | --- | --- | --- | --- | --- | --- |
| 877455 | N/A | N/A | 104228 | 104247 | GCTGCATTAATATGGAGTAT | 47 | 2056 |
| 877479 | N/A | N/A | 106092 | 106111 | TGCCCTTCCAACTCAATCAC | 82 | 2057 |
| 877503 | N/A | N/A | 108922 | 108941 | TTATAGATAAAACTTGAAGA | 126 | 2058 |
| 877527 | N/A | N/A | 111504 | 111523 | ATGCTTTAAACTGTGATTGC | 72 | 2059 |
| 877551 | N/A | N/A | 113499 | 113518 | TTAAGATGATGGGTTCTAGA | 77 | 2060 |
| 877575 | N/A | N/A | 116118 | 116137 | TGCAAGAAACACAAGTTGGA | 102 | 2061 |
| 877599 | N/A | N/A | 118373 | 118392 | ATGCACAGGAAATCTTATTC | 96 | 2062 |
| 877623 | N/A | N/A | 120463 | 120482 | ATATTGGAGATTAAAAGGGA | 121 | 2063 |
| 877647 | N/A | N/A | 122643 | 122662 | TTTACAAACGACATAATCCT | 117 | 2064 |
| 877671 | N/A | N/A | 126280 | 126299 | AGACCCAAATAACGATTTAA | 55 | 2065 |
| 877695 | N/A | N/A | 128683 | 128702 | CCAAATCAAGAGCTCACAAC | 91 | 2066 |
| 877719 | N/A | N/A | 133235 | 133254 | TAGTACTTTTTTCCAATAC | 65 | 2067 |
| 877743 | N/A | N/A | 136955 | 136974 | AGATATTCATGCTCACAGAC | 142 | 2068 |
| 877767 | N/A | N/A | 140322 | 140341 | TGTTGTCAGAGAGCCACTAC | 71 | 2069 |
| 877791 | N/A | N/A | 141782 | 141801 | GAAGCATTACAAATTTTTT | 105 | 2070 |
| 877815 | N/A | N/A | 144092 | 144111 | CCAAAGTACATACAATTCAA | 61 | 2071 |

TABLE 27

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
| --- | --- | --- | --- | --- | --- | --- | --- |
| 780241 | 3714 | 3733 | 82059 | 82078 | GCTCATATCTAAAGACCGCA | 29 | 222 |
| 803626 | N/A | N/A | 81586 87843 | 81605 87862 | ATAGTGTTTGAAGGAATAGC | 50 | 1788 |
| 876009 | 191 | 210 | 3310 | 3329 | TTTCCTTCCTGGACATTGTT | 50 | 2072 |
| 876033 | 738 | 757 | 18637 | 18656 | TAACGCACTTAACAATATCA | 31 | 2073 |
| 876057 | 874 | 893 | 21705 | 21724 | TCATAGCTTCCACCACAATA | 74 | 2074 |
| 876081 | 1342 | 1361 | 31058 | 31077 | CTTCCTTTGATGAAGAATGC | 39 | 2075 |
| 876105 | 1487 | 1506 | 35434 | 35453 | CCACTTTCAGCCACTTCAGG | 55 | 2076 |
| 876129 | 1865 | 1884 | 52779 | 52798 | GAATCCATAGCACCTTCCAG | 62 | 2077 |
| 876153 | 2532 | 2551 | 62153 | 62172 | TATACAAAATCCTCCAAGGC | 71 | 2078 |
| 876177 | 3198 | 3217 | 73734 | 73753 | TTCACATAGCTGTTGTGGAA | 76 | 2079 |
| 876201 | 3576 | 3595 | 77325 | 77344 | GAAACTCTCCACTTTAGGAC | 30 | 2080 |
| 876225 | 3857 | 3876 | 82202 | 82221 | AGATGCAGTTTCTCTACTCT | 43 | 81 |

TABLE 27-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876249 | 4320 | 4339 | 87224 | 87243 | GGGATGAGTACTATAGAATT | 44 | 2081 |
| 876273 | 4755 | 4774 | 92178 | 92197 | TTTCCGGTCAATTACGGGAA | 48 | 2082 |
| 876297 | 5077 | 5096 | 98225 | 98244 | CAATCTGGAATTTTTCTAGG | 67 | 2083 |
| 876321 | 5522 | 5541 | 100511 | 100530 | AGAGTTTCTCCTTCACCACA | 42 | 2084 |
| 876345 | 5875 | 5894 | N/A | N/A | AAAGCACCACAAGCTCTTGT | 18* | 2085 |
| 876369 | 6605 | 6624 | 129750 | 129769 | CAAATGCTTGCATTCCTGCT | 61 | 2086 |
| 876393 | 7263 | 7282 | 141624 | 141643 | TATTAGTCCACAGAGTTTTT | 108 | 2087 |
| 876417 | 8267 | 8286 | 146436 | 146455 | GAAGTTGTGTAAGATGCACT | 83 | 2088 |
| 876441 | 9084 | 9103 | 147253 | 147272 | GAGCTCTATTATATATGATT | 68 | 2089 |
| 876465 | N/A | N/A | 5078 | 5097 | TTATCTAGACCCTGCAGACC | 105 | 2090 |
| 876489 | N/A | N/A | 7262 | 7281 | GAAGGAAAAATACTACTTTT | 92 | 2091 |
| 876513 | N/A | N/A | 9756 | 9775 | AGTTTTAGAGGTTGTACCAA | 62 | 2092 |
| 876537 | N/A | N/A | 12772 | 12791 | GTAGTGGGCCGGTGGCCGTT | 77 | 2093 |
| 876561 | N/A | N/A | 15455 | 15474 | GCTTAATTGCTCTACAGTCC | 48 | 2094 |
| 876585 | N/A | N/A | 17472 | 17491 | ATCCTAATTGTCATCGAAAG | 99 | 2095 |
| 876609 | N/A | N/A | 19783 | 19802 | ATAAAATACATATTGTCTAA | 97 | 2096 |
| 876633 | N/A | N/A | 22053 | 22072 | TATAGAACTACATCTATAAA | 103 | 2097 |
| 876657 | N/A | N/A | 25245 | 25264 | TACAAGTTGCTACAATGGAG | 69 | 2098 |
| 876681 | N/A | N/A | 27636 | 27655 | ATGTCATGTCTGTGACACAC | 65 | 2099 |
| 876705 | N/A | N/A | 30159 | 30178 | TTATGATGTTTGAATGGCAC | 108 | 2100 |
| 876729 | N/A | N/A | 32279 | 32298 | ATTTTTTGCCCTCTAAAAAT | 109 | 2101 |
| 876753 | N/A | N/A | 33681 | 33700 | CCCAGCAAATGCTGCTGGTC | 96 | 2102 |
| 876777 | N/A | N/A | 36087 | 36106 | TGTGCCAATTATTTTTTTTA | 84 | 2103 |
| 876801 | N/A | N/A | 38237 | 38256 | AATACAGACATAGGTGTTTT | 86 | 2104 |
| 876825 | N/A | N/A | 40148 | 40167 | TTCTTAAAGAATTTCACATT | 111 | 2105 |
| 876849 | N/A | N/A | 42157 | 42176 | TTTCACTTCCCACATCCCCA | 91 | 2106 |
| 876873 | N/A | N/A | 45665 | 45684 | CACAGCACTTACTTGCTCTC | 45 | 2107 |
| 876897 | N/A | N/A | 48048 | 48067 | AATTCCAGGAACCACAAACT | 98 | 2108 |
| 876921 | N/A | N/A | 49975 | 49994 | TCAGTACAGGTTAATGATGA | 63 | 2109 |
| 876945 | N/A | N/A | 52174 | 52193 | CAGCTTCATGTAATAGGTTT | 44 | 2110 |
| 876969 | N/A | N/A | 55241 | 55260 | CCTCTAATATTACATATTAA | 111 | 2111 |
| 876993 | N/A | N/A | 57372 | 57391 | AATCCATAGGCAAGTGGGAT | 63 | 2112 |
| 877017 | N/A | N/A | 60530 | 60549 | ACCATTTCTCCTCCCGGCTC | 83 | 2113 |
| 877041 | N/A | N/A | 62800 | 62819 | AAAAGATAAAAATAGTGTCA | 136 | 2114 |
| 877065 | N/A | N/A | 65802 | 65821 | TTCCTTGACCCATCACTTTA | 87 | 2115 |

TABLE 27-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877089 | N/A | N/A | 67069 | 67088 | AAGGTTTCTTAAGTGGGATA | 60 | 2116 |
| 877113 | N/A | N/A | 70299 | 70318 | TGGCCTTCTGCTTAGAGACA | 36 | 2117 |
| 877137 | N/A | N/A | 72643 | 72662 | ACTACTTTTTATAACTAAAT | 150 | 2118 |
| 877161 | N/A | N/A | 73943 | 73962 | ATCAGATCTGTTTCCATTGC | 36 | 2119 |
| 877185 | N/A | N/A | 76014 | 76033 | TTTGAATTAATGATTTAACA | 128 | 2120 |
| 877209 | N/A | N/A | 78477 | 78496 | GAATTCCTGTTTATTGTCAT | 64 | 2121 |
| 877240 | N/A | N/A | 83109 | 83128 | AGCTGAAAAACAAGTAATAC | 112 | 2122 |
| 877264 | N/A | N/A | 85425 | 85444 | AATTAGAGAAAAAGACTAAA | 117 | 2123 |
| 877288 | N/A | N/A | 88395 | 88414 | AAGAAAAGAACAACTGTCCT | 75 | 2124 |
| 877312 | N/A | N/A | 90592 | 90611 | AGAGGACAAAAAATGATCTC | 86 | 2125 |
| 877336 | N/A | N/A | 92591 | 92610 | ACATTATGAATGTCATTTGA | 111 | 2126 |
| 877360 | N/A | N/A | 94819 | 94838 | TCCTGATTAACATTCTTTAA | 76 | 2127 |
| 877384 | N/A | N/A | 96218 | 96237 | ATCTGCTTCATTTCTCTTGG | 60 | 2128 |
| 877408 | N/A | N/A | 99066 | 99085 | GCAAATGATTTTACTGCTTA | 52 | 2129 |
| 877432 | N/A | N/A | 101696 | 101715 | CTTATTTGCCTCCCATATCC | 112 | 2130 |
| 877456 | N/A | N/A | 104260 | 104279 | TTTTTAAAGCCCTTCTCTAT | 110 | 2131 |
| 877480 | N/A | N/A | 106129 | 106148 | CTACACTTCCAACTTTGTGT | 97 | 2132 |
| 877504 | N/A | N/A | 108958 | 108977 | GAAACCTGTAAGAGACAGTC | 111 | 2133 |
| 877528 | N/A | N/A | 111524 | 111543 | GTGTGATGTTAAATTGATTC | 58 | 2134 |
| 877552 | N/A | N/A | 113529 | 113548 | CATTTTTATAGAAGGCAGAT | 68 | 2135 |
| 877576 | N/A | N/A | 116214 | 116233 | ACTCTCCTACTAGACTGTAA | 69 | 2136 |
| 877600 | N/A | N/A | 118773 | 118792 | ATTCTCTTCTTTTTATTCAG | 64 | 2137 |
| 877624 | N/A | N/A | 120519 | 120538 | ATTAGGCCCTGGGTTTCTGA | 87 | 2138 |
| 877648 | N/A | N/A | 122804 | 122823 | AAGATAAAACATATCCCTAA | 83 | 2139 |
| 877672 | N/A | N/A | 126378 | 126397 | TTTATGTAAATTTACTTGTC | 108 | 2140 |
| 877696 | N/A | N/A | 128758 | 128777 | TAAAGTCATTATAGTTGTAC | 83 | 2141 |
| 877720 | N/A | N/A | 133258 | 133277 | AAAAAACAGGCTTCACATTT | 127 | 2142 |
| 877744 | N/A | N/A | 137015 | 137034 | ATCTCTATAAGGAAACCTGA | 120 | 2143 |
| 877768 | N/A | N/A | 140412 | 140431 | TTTAACAATCATTAGTATAT | 88 | 2144 |
| 877792 | N/A | N/A | 141884 | 141903 | GAGAACATTCTTTGTAATAC | 66 | 2145 |
| 877816 | N/A | N/A | 144288 | 144307 | TGAGAAGAACTGGATGTTCA | 65 | 2146 |

TABLE 28

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 38 | 222 |
| 780619 | N/A | N/A | 81587 87844 | 81606 87863 | CATAGTGTTTGAAGGAATAG | 91 | 669 |
| 876010 | 304 | 323 | 3695 | 3714 | AGACGATCAACAGAGGCACA | 56 | 2147 |
| 876034 | 740 | 759 | 18639 | 18658 | GTTAACGCACTTAACAATAT | 46 | 2148 |
| 876058 | 875 | 894 | 21706 | 21725 | TTCATAGCTTCCACCACAAT | 72 | 2149 |
| 876082 | 1403 | 1422 | N/A | N/A | TTTCTGAAATTAACATTTTG | 88 | 2150 |
| 876106 | 1489 | 1508 | 35436 | 35455 | AGCCACTTTCAGCCACTTCA | 41 | 2151 |
| 876130 | 1867 | 1886 | 52781 | 52800 | CTGAATCCATAGCACCTTCC | 55 | 2152 |
| 876154 | 2537 | 2556 | 62158 | 62177 | TTTCCTATACAAAATCCTCC | 55 | 2153 |
| 876178 | 3212 | 3231 | N/A | N/A | AAACTCTTCAGAGTTTCACA | 108 | 2154 |
| 876202 | 3615 | 3634 | N/A | N/A | CAAGAAAGGCATAGCAGCAA | 77 | 2155 |
| 876226 | 3858 | 3877 | 82203 | 82222 | AAGATGCAGTTTCTCTACTC | 105 | 2156 |
| 876250 | 4383 | 4402 | 87287 | 87306 | TTCAGCCTGTCCCTTGCTGA | 91 | 2157 |
| 876274 | 4757 | 4776 | 92180 | 92199 | CGTTTCCGGTCAATTACGGG | 32 | 2158 |
| 876298 | 5151 | 5170 | 99157 | 99176 | GGGAAGCTCTATCACAGGCC | 31 | 2159 |
| 876322 | 5543 | 5562 | 100532 | 100551 | TATAATGCCCATTTCTTCAA | 99 | 2160 |
| 876346 | 5880 | 5899 | 113077 | 113096 | GTGGCAAAGCACCACAAGCT | 35 | 2161 |
| 876370 | 6606 | 6625 | 129751 | 129770 | CCAAATGCTTGCATTCCTGC | 73 | 2162 |
| 876394 | 7324 | 7343 | 142972 | 142991 | TTTTGTGTTTTGATTCCTTG | 65 | 2163 |
| 876418 | 8308 | 8327 | 146477 | 146496 | TTTCATTAGTACTTTTAATG | 120 | 2164 |
| 876442 | 9131 | 9150 | 147300 | 147319 | AAATTGCAAATACAAAGTAA | 137 | 2165 |
| 876466 | N/A | N/A | 5103 | 5122 | CTGGGTTGTCAAGTATAGCA | 81 | 2166 |
| 876490 | N/A | N/A | 7469 | 7488 | TATCATGTTAAATGGCATCT | 56 | 2167 |
| 876514 | N/A | N/A | 9834 | 9853 | CATATAATTTCTAAATTATG | 126 | 2168 |
| 876538 | N/A | N/A | 12900 | 12919 | GTTGATATATTAAAATATAG | 101 | 2169 |
| 876562 | N/A | N/A | 15482 | 15501 | ATTCTCATCTAGAATGCAAA | 93 | 2170 |
| 876586 | N/A | N/A | 17692 | 17711 | TACTCTACATTTATAGTCAT | 117 | 2171 |
| 876610 | N/A | N/A | 19865 | 19884 | GAAGGCTCACACCTTCAGAT | 72 | 2172 |
| 876634 | N/A | N/A | 22186 25650 25680 | 22205 25669 25699 | TATACAACATTTAAGTTGGA | 95 | 2173 |
| 876658 | N/A | N/A | 25710 25740 25804 25868 | 25729 25759 25823 25887 | CATCTGTGTATAAATATGTA | 85 | 2174 |
| 876682 | N/A | N/A | 27649 | 27668 | CTGATTCCCTCTCATGTCAT | 63 | 2175 |
| 876706 | N/A | N/A | 30201 | 30220 | ACTCCTTGCTACAGCTTGTA | 40 | 2176 |
| 876730 | N/A | N/A | 32460 | 32479 | GGTGAGATGAAAAGGAGGA | 64 | 2177 |

TABLE 28-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876754 | N/A | N/A | 33697 | 33716 | CTGTTTATCAAGTTCCCCCA | 61 | 2178 |
| 876778 | N/A | N/A | 36104 | 36123 | GTTTTCACTGCAACTTCTGT | 73 | 2179 |
| 876802 | N/A | N/A | 38252 | 38271 | TAAATGTGTTGGATGAATAC | 104 | 2180 |
| 876826 | N/A | N/A | 40280 | 40299 | TAGAGTTTCATATCCCTTTG | 58 | 2181 |
| 876850 | N/A | N/A | 42247 | 42266 | GAGTGGATTTATGTTACTGG | 35 | 2182 |
| 876874 | N/A | N/A | 45671 | 45690 | CCACATCACAGCACTTACTT | 60 | 2183 |
| 876898 | N/A | N/A | 48092 | 48111 | CATAGTCTGTAGGTAGTAGT | 54 | 2184 |
| 876922 | N/A | N/A | 50209 | 50228 | CGTTAATAATTTTCAAACAA | 145 | 2185 |
| 876946 | N/A | N/A | 52275 | 52294 | CTTGACCAGTAAAACGCAAT | 72 | 2186 |
| 876970 | N/A | N/A | 55359 | 55378 | CAGAGTCTGTCCTCTTCACT | 79 | 2187 |
| 876994 | N/A | N/A | 57490 | 57509 | GTTTATGTGATTTTAATTCA | 60 | 2188 |
| 877018 | N/A | N/A | 60774 | 60793 | AAGCACTACAGAGCTCTGAT | 75 | 2189 |
| 877042 | N/A | N/A | 63004 | 63023 | CTGACCAAAACTGGTGTTTT | 131 | 2190 |
| 877066 | N/A | N/A | 65861 | 65880 | TTTCCTGGAATATTAACCAT | 57 | 2191 |
| 877090 | N/A | N/A | 67071 | 67090 | AAAAGGTTTCTTAAGTGGGA | 70 | 2192 |
| 877114 | N/A | N/A | 70300 | 70319 | CTGGCCTTCTGCTTAGAGAC | 55 | 2193 |
| 877138 | N/A | N/A | 72664 | 72683 | ATATAATTTCTCATTAACCA | 79 | 2194 |
| 877162 | N/A | N/A | 73945 | 73964 | TAATCAGATCTGTTTCCATT | 52 | 2195 |
| 877186 | N/A | N/A | 76016 | 76035 | TATTTGAATTAATGATTTAA | 155 | 2196 |
| 877210 | N/A | N/A | 78507 | 78526 | TATTCTCTATGAAGGAAGAT | 72 | 2197 |
| 877241 | N/A | N/A | 83229 | 83248 | GACAAACAAATTATCAATTT | 70 | 2198 |
| 877265 | N/A | N/A | 86490 | 86509 | TCTTTTACATGTCACACTAT | 116 | 2199 |
| 877289 | N/A | N/A | 88459 | 88478 | TGTTGATATTTGCTTTCCGT | 45 | 2200 |
| 877313 | N/A | N/A | 90605 | 90624 | TGAAAATAAATGAGAGGAC | 107 | 2201 |
| 877337 | N/A | N/A | 92763 | 92782 | GAGAATTTTCATCTTTGAGA | 42 | 2202 |
| 877361 | N/A | N/A | 94894 | 94913 | TTATTTGTCCCCATACATGA | 102 | 2203 |
| 877385 | N/A | N/A | 96275 | 96294 | GTAGCAGAATTAATATTTTT | 59 | 2204 |
| 877409 | N/A | N/A | 99079 | 99098 | CCAACCTTGTTGAGCAAATG | 109 | 2205 |
| 877433 | N/A | N/A | 101710 | 101729 | CACCTGAAAACTGTCTTATT | 123 | 2206 |
| 877457 | N/A | N/A | 104825 | 104844 | ACTGGAATCAGAAATAGAAT | 119 | 2207 |
| 877481 | N/A | N/A | 106421 | 106440 | AATTAAGCTGTCCAAGCGAA | 150 | 2208 |
| 877505 | N/A | N/A | 109331 | 109350 | TGAATGTGAAGAATGCCCAT | 97 | 2209 |
| 877529 | N/A | N/A | 111530 | 111549 | TAGCTTGTGTGATGTTAAAT | 56 | 2210 |
| 877553 | N/A | N/A | 113596 | 113615 | GACTCATCTTTCCTCATTGG | 52 | 2211 |
| 877577 | N/A | N/A | 116216 | 116235 | TGACTCTCCTACTAGACTGT | 66 | 2212 |

TABLE 28-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877601 | N/A | N/A | 118774 | 118793 | CATTCTCTTCTTTTTATTCA | 60 | 2213 |
| 877625 | N/A | N/A | 120524 | 120543 | AAAAGATTAGGCCCTGGGTT | 71 | 2214 |
| 877649 | N/A | N/A | 122888 | 122907 | ATTATACATTTCCTTAGAAT | 142 | 2215 |
| 877673 | N/A | N/A | 126380 | 126399 | TATTTATGTAAATTTACTTG | 115 | 2216 |
| 877697 | N/A | N/A | 128864 | 128883 | ATTTTTACTGTGGACATAAA | 96 | 2217 |
| 877721 | N/A | N/A | 133263 | 133282 | GGTACAAAAAACAGGCTTCA | 55 | 2218 |
| 877745 | N/A | N/A | 137032 | 137051 | AACAAAGATGATGAACGATC | 134 | 2219 |
| 877769 | N/A | N/A | 140492 | 140511 | ATGAATGAACAACGAGGAAT | 145 | 2220 |
| 877793 | N/A | N/A | 141955 | 141974 | TGTGACAGAACTATGTCAAA | 87 | 2221 |
| 877817 | N/A | N/A | 144304 | 144323 | AATATAGCATAGTAATTGAG | 109 | 2222 |

TABLE 29

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 32 | 222 |
| 803627 | N/A | N/A | 81588 87845 | 81607 87864 | CCATAGTGTTTGAAGGAATA | 47 | 1789 |
| 876011 | 309 | 328 | 3700 | 3719 | GTCCAAGACGATCAACAGAG | 47 | 2223 |
| 876035 | 797 | 816 | 18696 | 18715 | AGGGAATGTAAACAATGCAG | 41 | 2224 |
| 876059 | 876 | 895 | 21707 | 21726 | TTTCATAGCTTCCACCACAA | 59 | 2225 |
| 876083 | 1408 | 1427 | N/A | N/A | GTATTTTTCTGAAATTAACA | 87 | 2226 |
| 876107 | 1490 | 1509 | 35437 | 35456 | CAGCCACTTTCAGCCACTTC | 49 | 2227 |
| 876131 | 1952 | 1971 | 52992 | 53011 | TTCTTTGTAATCAAGTATCC | 110 | 2228 |
| 876155 | 2558 | 2577 | 62179 | 62198 | CCAAGCCAAGAAGGTTCAAC | 51 | 2229 |
| 876179 | 3214 | 3233 | N/A | N/A | TCAAACTCTTCAGAGTTTCA | 97 | 2230 |
| 876203 | 3620 | 3639 | 80900 | 80919 | GGAGGCAAGAAAGGCATAGC | 46 | 2231 |
| 876227 | 3860 | 3879 | 82205 | 82224 | GAAAGATGCAGTTTCTCTAC | 59 | 2232 |
| 876251 | 4388 | 4407 | 87292 | 87311 | TCAACTTCAGCCTGTCCCTT | 105 | 2233 |
| 876275 | 4781 | 4800 | 92204 | 92223 | TTTTCTCTCACTAGTTGTAA | 48 | 2234 |
| 876299 | 5191 | 5210 | 99197 | 99216 | TTTCATATAGTCGGATGATA | 72 | 2235 |
| 876323 | 5566 | 5585 | 100555 | 100574 | GTTCTTCACCATCATTAAAA | 61 | 2236 |
| 876347 | 5979 | 5998 | 113176 | 113195 | AAGCAGGCGATCCAAGGAAC | 112 | 2237 |
| 876371 | 6645 | 6664 | 129790 | 129809 | AAATGAGAGCTGTCCTCTGT | 71 | 2238 |

TABLE 29-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876395 | 7354 | 7373 | 143002 | 143021 | AGAGGGTTTTCACTCTCCCA | 60 | 2239 |
| 876419 | 8313 | 8332 | 146482 | 146501 | TGTTTTTTCATTAGTACTTT | 91 | 2240 |
| 876443 | 9170 | 9189 | 147339 | 147358 | AATATGGTATTCATTTTTTT | 100 | 2241 |
| 876467 | N/A | N/A | 5161 | 5180 | ATGCTCAGGCTTGGGCAATT | 64 | 2242 |
| 876491 | N/A | N/A | 7474 | 7493 | TGGAATATCATGTTAAATGG | 65 | 2243 |
| 876515 | N/A | N/A | 10519 | 10538 | AAATAAATACTCAAGGCCAT | 88 | 2244 |
| 876539 | N/A | N/A | 13003 | 13022 | TATTTTCACCCAACTCCATA | 126 | 2245 |
| 876563 | N/A | N/A | 15487 | 15506 | TTTGCATTCTCATCTAGAAT | 108 | 2246 |
| 876587 | N/A | N/A | 17742 | 17761 | CCCCTGAGTCCTGGAGAACC | 99 | 2247 |
| 876611 | N/A | N/A | 19889 | 19908 | ATTGGGTTTTACTCTGCCTA | 41 | 2248 |
| 876635 | N/A | N/A | 22443 25651 25681 | 22462 25670 25700 | CCACATGCAAAAATATTTCT | 57 | 2249 |
| 876659 | N/A | N/A | 25711 25741 25805 25869 | 25730 25760 25824 25888 | ACATCTGTGTATAAATATGT | 61 | 2250 |
| 876683 | N/A | N/A | 27820 | 27839 | GATGAATATTCAATGGCATT | 36 | 2251 |
| 876707 | N/A | N/A | 30247 | 30266 | AAAACACAAAGGCTCACGGA | 73 | 2252 |
| 876731 | N/A | N/A | 32510 | 32529 | CTGTCAGTGCCCTGGCCACT | 42 | 2253 |
| 876755 | N/A | N/A | 33873 | 33892 | GTGGCTAGCTTCTAGCCAAG | 110 | 2254 |
| 876779 | N/A | N/A | 36197 | 36216 | TGTTATTATCATTCCTCTTT | 95 | 2255 |
| 876803 | N/A | N/A | 38423 | 38442 | AAAGCCTTTTATATATGCAT | 57 | 2256 |
| 876827 | N/A | N/A | 40345 | 40364 | CTTTTTAAGTCCTCCATATT | 65 | 2257 |
| 876851 | N/A | N/A | 42335 | 42354 | AGAAAACAGCAGCCATAGTA | 113 | 2258 |
| 876875 | N/A | N/A | 45683 | 45702 | AAGTGATTTCTCCACATCA | 62 | 2259 |
| 876899 | N/A | N/A | 48094 | 48113 | TGCATAGTCTGTAGGTAGTA | 23 | 2260 |
| 876923 | N/A | N/A | 50229 | 50248 | TGTTGTCACCCTTGTAAAAT | 85 | 2261 |
| 876947 | N/A | N/A | 52382 | 52401 | AATTCACTGAGGGTTAGAAT | 82 | 2262 |
| 876971 | N/A | N/A | 55369 | 55388 | AGCACATCCCCAGAGTCTGT | 76 | 2263 |
| 876995 | N/A | N/A | 57777 | 57796 | TAAATTGAAAGAATAGTAGA | 147 | 2264 |
| 877019 | N/A | N/A | 60820 | 60839 | AAATGCCCACCAGTCTCCAA | 93 | 2265 |
| 877043 | N/A | N/A | 63105 | 63124 | AAACCTTGATGTATAAAGGC | 115 | 2266 |
| 877067 | N/A | N/A | 65930 | 65949 | TACACAAGCCACGAAAGGAT | 72 | 2267 |
| 877091 | N/A | N/A | 67193 | 67212 | TCTTCATTGACACACCACAC | 52 | 2268 |

TABLE 29-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877115 | N/A | N/A | 70305 | 70324 | TCACTCTGGCCTTCTGCTTA | 76 | 2269 |
| 877139 | N/A | N/A | 72670 | 72689 | ATATCCATATAATTTCTCAT | 97 | 2270 |
| 877163 | N/A | N/A | 74025 | 74044 | GAATTAAATGATTAAAGTAT | 91 | 2271 |
| 877187 | N/A | N/A | 76071 | 76090 | TTTTGTAAATTATTTCCAGA | 80 | 2272 |
| 877211 | N/A | N/A | 78563 | 78582 | AAAAATTATTTTACTGAGTC | 158 | 2273 |
| 877242 | N/A | N/A | 83232 | 83251 | TGAGACAAACAAATTATCAA | 55 | 2274 |
| 877266 | N/A | N/A | 86571 | 86590 | CGCTGTTGAAGAAACCTAGT | 62 | 2275 |
| 877290 | N/A | N/A | 88524 | 88543 | GAGCCTGGAGGGAAAGACAC | 99 | 2276 |
| 877314 | N/A | N/A | 90620 | 90639 | GATCAAAGGCAAATATGAAA | 81 | 2277 |
| 877338 | N/A | N/A | 92815 | 92834 | ATTTCTAGCAAGGTAATATG | 82 | 2278 |
| 877362 | N/A | N/A | 94924 | 94943 | GTACAGGATGCAGCTACCTA | 56 | 2279 |
| 877386 | N/A | N/A | 96286 | 96305 | GTTACTAGAATGTAGCAGAA | 74 | 2280 |
| 877410 | N/A | N/A | 99359 | 99378 | CATCTCCCTAATTTCTCTAA | 92 | 2281 |
| 877434 | N/A | N/A | 101744 | 101763 | GTCATTTTATAAAATATGGC | 95 | 2282 |
| 877458 | N/A | N/A | 104836 | 104855 | AACTGTTACATACTGGAATC | 109 | 2283 |
| 877482 | N/A | N/A | 106589 | 106608 | ATGTGCAATTTAATATAATT | 89 | 2284 |
| 877506 | N/A | N/A | 109785 | 109804 | ACTTGTGGCCCACAGGTCGC | 87 | 2285 |
| 877530 | N/A | N/A | 111542 | 111561 | TGTTGAAATGTATAGCTTGT | 57 | 2286 |
| 877554 | N/A | N/A | 113660 | 113679 | GACATGTGAGATGGTCATGC | 55 | 2287 |
| 877578 | N/A | N/A | 116500 | 116519 | TCTTCATAGCTTAAAGTAAA | 79 | 2288 |
| 877602 | N/A | N/A | 118817 | 118836 | GAATCTACAAATCTAACTTT | 118 | 2289 |
| 877626 | N/A | N/A | 120677 | 120696 | AAAATTGGAGGCAGAGTTTA | 94 | 2290 |
| 877650 | N/A | N/A | 122924 | 122943 | ATATTGTTACAGATACAATG | 90 | 2291 |
| 877674 | N/A | N/A | 126393 | 126412 | CTCCATAATCCTATATTTAT | 83 | 2292 |
| 877698 | N/A | N/A | 128986 | 129005 | AAGTATGTCTAAGCTTTTTA | 59 | 2293 |
| 877722 | N/A | N/A | 133331 | 133350 | TTGAAATTTTCTTTGACCA | 36 | 2294 |
| 877746 | N/A | N/A | 137262 | 137281 | TTTCCATCTTAAATGATTAG | 86 | 2295 |
| 877770 | N/A | N/A | 140513 | 140532 | AATAGAAGAAGGCACTACAG | 111 | 2296 |
| 877794 | N/A | N/A | 142230 | 142249 | AAATAAAAATATAAAGTGGC | 154 | 2297 |
| 877818 | N/A | N/A | 144312 | 144331 | TGAGGCAAAATATAGCATAG | 93 | 2298 |

TABLE 30

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 43 | 222 |
| 780620 | N/A | N/A | 81590<br>87847 | 81609<br>87866 | AGCCATAGTGTTTGAAGGAA | 28 | 670 |
| 876013 | 339 | 358 | 3730 | 3749 | CTGCTGCACACTCGCGACTC | 55 | 2299 |
| 876037 | 821 | 840 | N/A | N/A | TCCACATTATTGCAAGGAAT | 51 | 2300 |
| 876061 | 930 | 949 | 21761 | 21780 | CCTATGGAGCAAACAGCAAC | 89 | 2301 |
| 876085 | 1455 | 1474 | 35402 | 35421 | CTTCTGCATTAACTCCAAAA | 49 | 2302 |
| 876109 | 1493 | 1512 | 35440 | 35459 | TTACAGCCACTTTCAGCCAC | 33 | 2303 |
| 876133 | 2042 | 2061 | 53082 | 53101 | TTAGTCTGTATTTCAGCAAC | 81 | 2304 |
| 876157 | 2626 | 2645 | 65464 | 65483 | TTCTTGCTAGTGTAGATGCT | 48 | 2305 |
| 876181 | 3216 | 3235 | N/A | N/A | TGTCAAACTCTTCAGAGTTT | 40 | 2306 |
| 876205 | 3703 | 3722 | N/A | N/A | AAGACCGCAAGTGTGGAAGA | 56 | 2307 |
| 876229 | 3929 | 3948 | 83924 | 83943 | CTGACATCCAGAGATGTCAG | 89 | 2308 |
| 876253 | 4432 | 4451 | N/A | N/A | AAGAAGCGCGAGCCTTTATA | 103 | 2309 |
| 876277 | 4877 | 4896 | 93338 | 93357 | AACTGCAGTGCTGGGTCTTG | 49 | 2310 |
| 876301 | 5194 | 5213 | 99200 | 99219 | GCATTTCATATAGTCGGATG | 22 | 2311 |
| 876325 | 5610 | 5629 | 100599 | 100618 | TTCCTCTGCTTTCTTCATCA | 56 | 2312 |
| 876349 | 6023 | 6042 | 113220 | 113239 | ATCCTGTGCTGTAGGGTTCT | 58 | 2313 |
| 876373 | 6689 | 6708 | N/A | N/A | TCAGCAACTTCCTCAGAAGT | 97 | 2314 |
| 876397 | 7400 | 7419 | 143048 | 143067 | TGGCCTCCTCCAGTTCCTAT | 73 | 2315 |
| 876421 | 8402 | 8421 | 146571 | 146590 | CTATTATGTCTAGGAAAGAC | 138 | 2316 |
| 876445 | N/A | N/A | 3487 | 3506 | CTCCTTAAGAGTCCGGGTTT | 103 | 2317 |
| 876469 | N/A | N/A | 5188 | 5207 | TGACACTCATAACTACTCCG | 68 | 2318 |
| 876493 | N/A | N/A | 7785 | 7804 | AATACAATTAAATTGGTAGT | 97 | 2319 |
| 876517 | N/A | N/A | 10746 | 10765 | AAAATCTACAACTTAACCAG | 107 | 2320 |
| 876541 | N/A | N/A | 13064 | 13083 | AAAAAGTTAAAAGCACTACT | 90 | 2321 |
| 876565 | N/A | N/A | 15570 | 15589 | CTTTAAGAATATCTCCTACA | 97 | 2322 |
| 876589 | N/A | N/A | 17908 | 17927 | AGTGATCAACATTCATTTTT | 58 | 2323 |
| 876613 | N/A | N/A | 19993 | 20012 | TTATTGTTCAGCCCCACCCA | 92 | 2324 |
| 876637 | N/A | N/A | 22715<br>25662<br>25692 | 22734<br>25681<br>25711 | CTATCCTGTGAACAATATTG | 74 | 2325 |
| 876661 | N/A | N/A | 25722<br>25752<br>25816<br>25880 | 25741<br>25771<br>25835<br>25899 | TATATTTATATACATCTGTG | 60 | 2326 |
| 876685 | N/A | N/A | 27910 | 27929 | AGTTAAGTGAAACATTAGCT | 98 | 2327 |
| 876709 | N/A | N/A | 30373 | 30392 | AACAAATAGACGGTCAAGAT | 58 | 2328 |
| 876733 | N/A | N/A | 32619 | 32638 | TCCCTGTCCAGACCTCTTTA | 83 | 2329 |

TABLE 30-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876757 | N/A | N/A | 33996 | 34015 | ATACTGCCAGAGCCTGAAAA | 81 | 2330 |
| 876781 | N/A | N/A | 36419 | 36438 | TTAGTTAGACTGATGTTAAA | 96 | 2331 |
| 876805 | N/A | N/A | 38456 | 38475 | GAAGAAATTATTTGTGCCTC | 56 | 2332 |
| 876829 | N/A | N/A | 40740 | 40759 | GAGGTCCTACTATTCAAATG | 49 | 2333 |
| 876853 | N/A | N/A | 42906 | 42925 | CTTCTCTTTTTCATACTCAG | 47 | 2334 |
| 876877 | N/A | N/A | 46382 | 46401 | AGAAGACTGGTTTTACTTTA | 78 | 2335 |
| 876901 | N/A | N/A | 48096 | 48115 | GGTGCATAGTCTGTAGGTAG | 28 | 2336 |
| 876925 | N/A | N/A | 50288 | 50307 | TTCACAGGTGTGTATTTCAC | 62 | 2337 |
| 876949 | N/A | N/A | 52569 | 52588 | AAATCAGTATCCTTGATTTT | 92 | 2338 |
| 876973 | N/A | N/A | 55733 | 55752 | GGAAAAAGAACTAATACCCT | 97 | 2339 |
| 876997 | N/A | N/A | 57805 | 57824 | AAAATCCTGTTGGGTAGAAA | 84 | 2340 |
| 877021 | N/A | N/A | 61061 | 61080 | CCCTTACAGCTAGCAAGCAA | 75 | 2341 |
| 877045 | N/A | N/A | 63132 | 63151 | AACTTTTGGAGCCTACTGAG | 79 | 2342 |
| 877069 | N/A | N/A | 66149 | 66168 | TCATTATATATTTCACCATA | 47 | 2343 |
| 877093 | N/A | N/A | 67368 | 67387 | TAAGAATAAGGTATAAATCA | 114 | 2344 |
| 877117 | N/A | N/A | 70856 | 70875 | ATTTTAAATTCCCCTACTCT | 87 | 2345 |
| 877141 | N/A | N/A | 72684 | 72703 | TGAGTGAAAAGCTATATCC | 52 | 2346 |
| 877165 | N/A | N/A | 74316 | 74335 | AGAGCTATCCTATCAACAAA | 83 | 2347 |
| 877189 | N/A | N/A | 76262 | 76281 | CTTACACACCTCTGGTAACT | 47 | 2348 |
| 877213 | N/A | N/A | 78841 | 78860 | TTTGTCTGTGCTCTGAACTT | 69 | 2349 |
| 877244 | N/A | N/A | 83428 | 83447 | CCTAATTGGAGTAATTTCTT | 89 | 2350 |
| 877268 | N/A | N/A | 86896 | 86915 | TCCATACAGTCTACCAGGTT | 50 | 2351 |
| 877292 | N/A | N/A | 89032 | 89051 | GGCATCAAAAACATTTTCTC | 23 | 2352 |
| 877316 | N/A | N/A | 90814 | 90833 | AGATGCCTGCTCTGCTAATG | 83 | 2353 |
| 877340 | N/A | N/A | 93050 | 93069 | TTCACACATAAGTAGAAATT | 106 | 2354 |
| 877364 | N/A | N/A | 95117 | 95136 | CTGTATAAGATATACCCATC | 35 | 2355 |
| 877388 | N/A | N/A | 96349 | 96368 | TGCTATTCATATAGAGTCTC | 27 | 2356 |
| 877412 | N/A | N/A | 99735 | 99754 | ATTTTGGAAACCAGTAACAC | 94 | 2357 |
| 877436 | N/A | N/A | 101885 | 101904 | TTTGAGTATGTCACCATGTA | 59 | 2358 |
| 877460 | N/A | N/A | 104875 | 104894 | ATTAGTTAGGATTGTTGGTA | 62 | 2359 |
| 877484 | N/A | N/A | 106759 | 106778 | AGGATTCTCAGATACAGTGT | 99 | 2360 |
| 877508 | N/A | N/A | 109926 | 109945 | AATCCTATGGTGAGTACCTC | 94 | 2361 |
| 877532 | N/A | N/A | 111674 | 111693 | GATCCAATGGCAACAACCCT | 97 | 2362 |
| 877556 | N/A | N/A | 113970 | 113989 | GGAATGTAAGGTGACTCTCA | 80 | 2363 |
| 877580 | N/A | N/A | 116687 | 116706 | AGACTAGCAAAATAGCTTTT | 97 | 2364 |

TABLE 30-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877604 | N/A | N/A | 118908 | 118927 | GTGGACCTGAATTTGATTTG | 58 | 2365 |
| 877628 | N/A | N/A | 120831 | 120850 | AGGAAGATTCATTAAACGGA | 76 | 2366 |
| 877652 | N/A | N/A | 123128 | 123147 | AAAGATGGAGCTCAGCAGTC | 89 | 2367 |
| 877676 | N/A | N/A | 126731 | 126750 | TTTGCCTTATAACTATTTTT | 92 | 2368 |
| 877700 | N/A | N/A | 129195 | 129214 | ATTCTGTTTTTGATCTGGAG | 78 | 2369 |
| 877724 | N/A | N/A | 133350 | 133369 | CCTTGCCCAATTCCATCCAT | 49 | 2370 |
| 877748 | N/A | N/A | 138041 | 138060 | TATTCTTGTTTGAAACTGGT | 46 | 2371 |
| 877772 | N/A | N/A | 140642 | 140661 | CCCTCACACTAGATTATGAG | 72 | 2372 |
| 877796 | N/A | N/A | 142347 | 142366 | AGAAAAACTGTCAGATGAAT | 116 | 2373 |
| 877820 | N/A | N/A | 144537 | 144556 | ATATTCTAGTGAAGAGACTA | 164 | 2374 |

TABLE 31

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 19 | 222 |
| 780621 | N/A | N/A | 81593 87850 | 81612 87869 | AAAAGCCATAGTGTTTGAAG | 35 | 671 |
| 876016 | 395 | 414 | 10419 | 10438 | CTTTGCATTGTACCTGGACA | 37 | 2375 |
| 876040 | 825 | 844 | N/A | N/A | GACTTCCACATTATTGCAAG | 36 | 2376 |
| 876064 | 1070 | 1089 | N/A | N/A | ATAGTCTCAGTGAGGAGGGC | 50 | 2377 |
| 876088 | 1468 | 1487 | 35415 | 35434 | GAGAATGTATATGCTTCTGC | 15 | 2378 |
| 876112 | 1539 | 1558 | 37588 | 37607 | TATATCCAGGGAAGTGTTGC | 71 | 2379 |
| 876136 | 2091 | 2110 | 56025 | 56044 | AGAAAAAGATGCTGACAATT | 86 | 2380 |
| 876160 | 2802 | 2821 | N/A | N/A | GCCTTCACTTCCTTCACTAT | 59 | 2381 |
| 876184 | 3223 | 3242 | 76357 | 76376 | CCAAATGTGTCAAACTCTTC | 39 | 2382 |
| 876208 | 3791 | 3810 | 82136 | 82155 | TTATGGCTAAATAAGAGTTC | 69 | 2383 |
| 876232 | 4012 | 4031 | 84007 | 84026 | GATGCAGTTCATCCAAAGGA | 35 | 2384 |
| 876256 | 4609 | 4628 | 88710 | 88729 | TTTTCCGAAGTTTTGCCAAA | 73 | 2385 |
| 876280 | 4967 | 4986 | 98115 | 98134 | GGGTGTTTTGGACAACCTTC | 37 | 2386 |
| 876304 | 5198 | 5217 | 99204 | 99223 | TAAGGCATTTCATATAGTCG | 48 | 2387 |
| 876328 | 5647 | 5666 | 101285 | 101304 | TGAGCCTTGGTTGATCTGGA | 21 | 2388 |
| 876352 | 6072 | 6091 | 118405 | 118424 | AATCATGGCTGAGTGGAGGT | 80 | 2389 |
| 876376 | 6738 | 6757 | 132448 | 132467 | TTCCTTTTCAACAGGAAGAT | 68 | 2390 |

TABLE 31-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876400 | 7495 | 7514 | N/A | N/A | TTCCTAGCTGTGCTGTCATC | 91 | 2391 |
| 876424 | 8539 | 8558 | 146708 | 146727 | GAAGCAGATTAGAAAACAAG | 86 | 2392 |
| 876448 | N/A | N/A | 3736 | 3755 | CTTTACCTGCTGCACACTCG | 63 | 2393 |
| 876472 | N/A | N/A | 5572 | 5591 | CCAGAGACTGGAAATGAAAG | 95 | 2394 |
| 876496 | N/A | N/A | 7851 | 7870 | TCCATTAATCTATTCAATTA | 78 | 2395 |
| 876520 | N/A | N/A | 10808 | 10827 | GTATCGATTCTATTATTAAA | 71 | 2396 |
| 876544 | N/A | N/A | 13929 | 13948 | AATCAAGCTACCCTAATCCT | 95 | 2397 |
| 876568 | N/A | N/A | 15860 | 15879 | TAAATGAGATAAACTCCCAG | 96 | 2398 |
| 876592 | N/A | N/A | 18000 | 18019 | TATTGGGCAACAACCTGAAA | 95 | 2399 |
| 876616 | N/A | N/A | 20210 | 20229 | TTTTAGCTGCTACTTTCTTG | 84 | 2400 |
| 876640 | N/A | N/A | 23220 | 23239 | GATACATAAAAAAGAGTAAA | 135 | 2401 |
| 876664 | N/A | N/A | 26207 | 26226 | AGATTAAAACATTATCAGAT | 84 | 2402 |
| 876688 | N/A | N/A | 28199 | 28218 | ACAACTGTTAGTTTCCTTGA | 55 | 2403 |
| 876712 | N/A | N/A | 30796 | 30815 | TTTCAAAAGCATATGCAGCA | 51 | 2404 |
| 876736 | N/A | N/A | 32794 | 32813 | CAGTCGAAATTTCACAAAGT | 66 | 2405 |
| 876760 | N/A | N/A | 34084 | 34103 | CTTAAGTACTGCTTTTAAAA | 69 | 2406 |
| 876784 | N/A | N/A | 36835 | 36854 | CCTCCCCTCCTTGGGTAACC | 93 | 2407 |
| 876808 | N/A | N/A | 38630 | 38649 | TCAGCCTTTCCTTCCACACT | 74 | 2408 |
| 876832 | N/A | N/A | 40891 | 40910 | TATTACACCTTAAGAAGATG | 106 | 2409 |
| 876856 | N/A | N/A | 42932 | 42951 | TTACACAATTTAAATGTAAT | 104 | 2410 |
| 876880 | N/A | N/A | 46724 | 46743 | TTAGTTCCAGAAAATACTAT | 71 | 2411 |
| 876904 | N/A | N/A | 48100 | 48119 | CCAGGGTGCATAGTCTGTAG | 44 | 2412 |
| 876928 | N/A | N/A | 50374 | 50393 | CTTCTACAAAAAAAAGTCAG | 87 | 2413 |
| 876952 | N/A | N/A | 52953 | 52972 | CACTGAATTTCTAGGAAAAT | 117 | 2414 |
| 876976 | N/A | N/A | 56393 | 56412 | AGAATACTGAGCAAAGACAA | 88 | 2415 |
| 877000 | N/A | N/A | 58100 | 58119 | GTCTAACACAACTCCACCCT | 95 | 2416 |
| 877024 | N/A | N/A | 61215 | 61234 | CCAAGATAACAGGTAATAGA | 60 | 2417 |
| 877048 | N/A | N/A | 63290 | 63309 | CTTCCAGACTGGTGATAGCA | 97 | 2418 |
| 877072 | N/A | N/A | 66302 | 66321 | AGACACAATATTTTGGAACA | 53 | 2419 |
| 877096 | N/A | N/A | 67753 | 67772 | GTTAGAAATTTTAAAAGACT | 86 | 2420 |
| 877120 | N/A | N/A | 71190 | 71209 | CTGGAATAGGGTCTAGCAGC | 37 | 2421 |
| 877144 | N/A | N/A | 72946 | 72965 | AAAAATGGGCCCCTATTAAA | 102 | 2422 |
| 877168 | N/A | N/A | 74838 | 74857 | TCCCTTAAATATACTTAAAA | 101 | 2423 |
| 877192 | N/A | N/A | 76677 | 76696 | GTTGTTAAAACTCATTGCTA | 38 | 2424 |
| 877216 | N/A | N/A | 79254 | 79273 | GACCACTTCTCAAACTATTA | 64 | 2425 |
| 877247 | N/A | N/A | 83670 | 83689 | CTCCCAAACAATCTATGTCA | 41 | 2426 |

TABLE 31-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877271 | N/A | N/A | 87005 | 87024 | AACCGATCAAAGTACCTAGC | 36 | 2427 |
| 877295 | N/A | N/A | 89220 | 89239 | CACAGTGACAAAATTCATGA | 50 | 2428 |
| 877319 | N/A | N/A | 91037 | 91056 | TATCTCTTAACCCAGAGAAT | 79 | 2429 |
| 877343 | N/A | N/A | 93174 | 93193 | CTGGGACTAGAAGCTGTGCA | 37 | 2430 |
| 877367 | N/A | N/A | 95220 | 95239 | ACTTAATTACTCCACAGAAT | 91 | 2431 |
| 877391 | N/A | N/A | 96751 | 96770 | TTCTCTCATTTGAATATCAG | 63 | 2432 |
| 877415 | N/A | N/A | 99949 | 99968 | TAAAAAGAGTTAAATCCCCT | 88 | 2433 |
| 877439 | N/A | N/A | 102322 | 102341 | TGTACAAAGTATATCTTTTT | 45 | 2434 |
| 877463 | N/A | N/A | 104975 | 104994 | ATTAGATTGTAAATATGTTA | 147 | 2435 |
| 877487 | N/A | N/A | 106908 | 106927 | CCAAGTTTCTACATTTCTAA | 64 | 2436 |
| 877511 | N/A | N/A | 110185 | 110204 | TTGTTGAGAAAAGCACAGAT | 94 | 2437 |
| 877535 | N/A | N/A | 111992 | 112011 | CATTGGCATTCATTCAATCC | 73 | 2438 |
| 877559 | N/A | N/A | 114281 | 114300 | GGTATCTGCAAGGAACCTCA | 87 | 2439 |
| 877583 | N/A | N/A | 117201 | 117220 | TTCAATTGTATGAGGGCCTG | 102 | 2440 |
| 877607 | N/A | N/A | 119250 | 119269 | TTACTTCCTGCTCAAACTGA | 99 | 2441 |
| 877631 | N/A | N/A | 121200 | 121219 | CAGGAGCTCTGCTCTCAGGC | 67 | 2442 |
| 877655 | N/A | N/A | 123752 | 123771 | GTACTACTCTTTCTTTCTTT | 62 | 2443 |
| 877679 | N/A | N/A | 126891 | 126910 | TTTTTTCTGATTTGATTTGT | 81 | 2444 |
| 877703 | N/A | N/A | 129329 | 129348 | GCATGCAATTCTATATTGCA | 100 | 2445 |
| 877727 | N/A | N/A | 133490 | 133509 | CCCACTTCCTTCCAACAAGG | 77 | 2446 |
| 877751 | N/A | N/A | 138235 | 138254 | GAAAGGTTATTGCCCAAGTT | 45 | 2447 |
| 877775 | N/A | N/A | 140814 | 140833 | GCCACATCAGCATGGCAAAC | 50 | 2448 |
| 877799 | N/A | N/A | 142668 | 142687 | TACCAAAGCTATCTAATTCA | 99 | 2449 |
| 877823 | N/A | N/A | 144798 | 144817 | TTAAACGAGGTAATGTGTGT | 60 | 2450 |

TABLE 32

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 37 | 222 |
| 803631 | N/A | N/A | 81594 87851 | 81613 87870 | AAAAAGCCATAGTGTTTGAA | 80 | 1793 |
| 876017 | 400 | 419 | 10424 | 10443 | TTAAGCTTTGCATTGTACCT | 40 | 2451 |
| 876041 | 827 | 846 | N/A | N/A | AGGACTTCCACATTATTGCA | 37 | 2452 |

TABLE 32-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876065 | 1084 | 1103 | 29345 | 29364 | CTTGATTTAAGAAAATAGTC | 83 | 2453 |
| 876089 | 1469 | 1488 | 35416 | 35435 | GGAGAATGTATATGCTTCTG | 27 | 2454 |
| 876113 | 1555 | 1574 | 37604 | 37623 | GGACCACTGCTGCCATTATA | 43 | 2455 |
| 876137 | 2130 | 2149 | 56064 | 56083 | GAATATTACTAAGTCAAATG | 84 | 2456 |
| 876161 | 2843 | 2862 | 71686 | 71705 | CCTACACTAATTGAATTAGA | 52 | 2457 |
| 876185 | 3224 | 3243 | 76358 | 76377 | TCCAAATGTGTCAAACTCTT | 31 | 2458 |
| 876209 | 3796 | 3815 | 82141 | 82160 | TCTGATTATGGCTAAATAAG | 41 | 2459 |
| 876233 | 4017 | 4036 | 84012 | 84031 | GTTAAGATGCAGTTCATCCA | 55 | 2460 |
| 876257 | 4621 | 4640 | 88722 | 88741 | CGTTTATGATGGTTTTCCGA | 79 | 2461 |
| 876281 | 5042 | 5061 | 98190 | 98209 | GACATGTAGTTCTTTGGAAA | 44 | 2462 |
| 876305 | 5199 | 5218 | 99205 | 99224 | ATAAGGCATTTCATATAGTC | 74 | 2463 |
| 876329 | 5648 | 5667 | 101286 | 101305 | GTGAGCCTTGGTTGATCTGG | 55 | 2464 |
| 876353 | 6093 | 6112 | 118426 | 118445 | GGGTTTCAGGTCTCGGTATA | 72 | 2465 |
| 876377 | 6777 | 6796 | 132487 | 132506 | CAGGAGAGTACCAGACTGTG | 71 | 2466 |
| 876401 | 7516 | 7535 | 145119 | 145138 | CCAGCATGACATTTTTAAGG | 37 | 2467 |
| 876425 | 8551 | 8570 | 146720 | 146739 | AAGCATTAGAATGAAGCAGA | 56 | 2468 |
| 876449 | N/A | N/A | 3738 | 3757 | GCCTTTACCTGCTGCACACT | 69 | 2469 |
| 876473 | N/A | N/A | 5806 | 5825 | CTCTAAATTAATTACTTAAC | 97 | 2470 |
| 876497 | N/A | N/A | 7895 | 7914 | TGATTAAATAGAATCTCTGG | 89 | 2471 |
| 876521 | N/A | N/A | 10905 | 10924 | AAATGTACTATTTAAAGACA | 84 | 2472 |
| 876545 | N/A | N/A | 13978 | 13997 | GGCTGTCCCATCACTAGGTC | 40 | 2473 |
| 876569 | N/A | N/A | 15888 | 15907 | GTTAGACTTATCAAGCTCTA | 41 | 2474 |
| 876593 | N/A | N/A | 18037 | 18056 | TTTGATCAAGCCAGTAAGTT | 47 | 2475 |
| 876617 | N/A | N/A | 20433 | 20452 | TGTTTAAAAAAGGCTGTTT | 88 | 2476 |
| 876641 | N/A | N/A | 23260 | 23279 | ATTATCTTAGGGAAAGGACA | 83 | 2477 |
| 876665 | N/A | N/A | 26250 | 26269 | TGTGCTACTCTGACACCTGG | 41 | 2478 |
| 876689 | N/A | N/A | 28210 | 28229 | GTATATTTGTCACAACTGTT | 52 | 2479 |
| 876713 | N/A | N/A | 30800 | 30819 | GCTTTTTCAAAAGCATATGC | 35 | 2480 |
| 876737 | N/A | N/A | 32826 | 32845 | TGTAACCAGTCCTCAGACAC | 73 | 2481 |
| 876761 | N/A | N/A | 34100 | 34119 | ACATAAAAAGTTTAACTTA | 105 | 2482 |
| 876785 | N/A | N/A | 36869 | 36888 | AAAGTCCCAGTTTAAACACA | 73 | 2483 |
| 876809 | N/A | N/A | 38643 | 38662 | TTTTCTTTGGGCCTCAGCCT | 110 | 2484 |
| 876833 | N/A | N/A | 40900 | 40919 | GAGGCTGCCTATTACACCTT | 60 | 2485 |
| 876857 | N/A | N/A | 42939 | 42958 | TTTTGCATTACACAATTTAA | 74 | 2486 |
| 876881 | N/A | N/A | 46818 | 46837 | TGGAGTTAGGCCATATGAAT | 45 | 2487 |

TABLE 32-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876905 | N/A | N/A | 48102 | 48121 | GTCCAGGGTGCATAGTCTGT | 28 | 2488 |
| 876929 | N/A | N/A | 50419 | 50438 | TACCAGTATCTTAAATTCAG | 93 | 2489 |
| 876953 | N/A | N/A | 53117 | 53136 | AGTTCCCAAATTCTTTCCAA | 86 | 2490 |
| 876977 | N/A | N/A | 56418 | 56437 | AATGGCAGGGCTCTTACATT | 45 | 2491 |
| 877001 | N/A | N/A | 58449 | 58468 | GAGCCACCCTGCATGAAGCT | 74 | 2492 |
| 877025 | N/A | N/A | 61291 | 61310 | GCACTGCATGCTGGCCCTAC | 122 | 2493 |
| 877049 | N/A | N/A | 63355 | 63374 | TTATATAATGTGGTGAATGG | 124 | 2494 |
| 877073 | N/A | N/A | 66309 | 66328 | TGACTTGAGACACAATATTT | 52 | 2495 |
| 877097 | N/A | N/A | 67953 | 67972 | ATTGTGAACAAAGAAAATCC | 110 | 2496 |
| 877121 | N/A | N/A | 71306 | 71325 | CAAATCAATCAACGGTTACA | 60 | 2497 |
| 877145 | N/A | N/A | 73081 | 73100 | TAATTGGAGGAAATTCAACC | 113 | 2498 |
| 877169 | N/A | N/A | 74847 | 74866 | GAAAAAACATCCCTTAAATA | 119 | 2499 |
| 877193 | N/A | N/A | 77052 | 77071 | TAAAGTTGTAATATTCATT | 88 | 2500 |
| 877217 | N/A | N/A | 79613 | 79632 | TTCAGAGTCTTGAGTTTCAT | 51 | 2501 |
| 877248 | N/A | N/A | 84372 | 84391 | TCTTTAGATTGTGTAATTGG | 43 | 2502 |
| 877272 | N/A | N/A | 87027 | 87046 | CACTTTTAGCATATTTGTCA | 80 | 2503 |
| 877296 | N/A | N/A | 89765 | 89784 | AAATGGAACAGAACTAAGCT | 100 | 2504 |
| 877320 | N/A | N/A | 91067 | 91086 | CAAATGGTTACTCAAGAGAC | 68 | 2505 |
| 877344 | N/A | N/A | 93198 | 93217 | ATTTCAGCATAGCTAGTGAC | 102 | 2506 |
| 877368 | N/A | N/A | 95236 | 95255 | CTTTCATGGAGTTTCAACTT | 100 | 2507 |
| 877392 | N/A | N/A | 96941 | 96960 | TCCCATGTTGTGTACTTTAT | 36 | 2508 |
| 877416 | N/A | N/A | 100066 | 100085 | TGCACACAACACAAGTGATT | 64 | 2509 |
| 877440 | N/A | N/A | 102409 | 102428 | TCTCCATTCCACAACATATA | 98 | 2510 |
| 877464 | N/A | N/A | 105094 | 105113 | ATGGAAAGCCTCTACCTATT | 111 | 2511 |
| 877488 | N/A | N/A | 106972 | 106991 | TGGAGGCAGCTAGGAGTCTG | 100 | 2512 |
| 877512 | N/A | N/A | 110233 | 110252 | CAAAGGCCTAAAGCCAATTA | 128 | 2513 |
| 877536 | N/A | N/A | 112047 | 112066 | AGGCCTTCCAGACCTTCTCG | 108 | 2514 |
| 877560 | N/A | N/A | 114295 | 114314 | GATATAAAGCCTCTGGTATC | 98 | 2515 |
| 877584 | N/A | N/A | 117209 | 117228 | CCTGAACTTTCAATTGTATG | 73 | 2516 |
| 877608 | N/A | N/A | 119259 | 119278 | CTAAATGATTTACTTCCTGC | 77 | 2517 |
| 877632 | N/A | N/A | 121414 | 121433 | TGCCATAGGACCCAGAATTA | 146 | 2518 |
| 877656 | N/A | N/A | 124006 | 124025 | CAGAAAGTTATCAAATATGT | 90 | 2519 |
| 877680 | N/A | N/A | 126954 | 126973 | AGCTCGAAAAAGAAATTGCA | 80 | 2520 |
| 877704 | N/A | N/A | 129393 | 129412 | TAACTTGAAAAGAAAATCTC | 105 | 2521 |
| 877728 | N/A | N/A | 133512 | 133531 | CCTAATCACATTGACAACTG | 101 | 2522 |
| 877752 | N/A | N/A | 138252 | 138271 | GAGATGACTGAAGATGTGAA | 73 | 2523 |

TABLE 32-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877776 | N/A | N/A | 140877 | 140896 | TTTCCCTTTCAACCTAAGAC | 99 | 2524 |
| 877800 | N/A | N/A | 142754 | 142773 | CTTTACTTGAAGCATAAATT | 93 | 2525 |
| 877824 | N/A | N/A | 144813 | 144832 | CCCAAAGTTACAATGTTAAA | 72 | 2526 |

TABLE 33

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 38 | 222 |
| 780622 | N/A | N/A | 81596 87853 | 81615 87872 | CTAAAAGCCATAGTGTTTG | 53 | 672 |
| 876019 | 486 | 505 | 13752 | 13771 | ACTGGCATTATGAACTGTTA | 37 | 2527 |
| 876043 | 829 | 848 | 21660 | 21679 | TGAGGACTTCCACATTATTG | 47 | 2528 |
| 876067 | 1156 | 1175 | 29417 | 29436 | CTTCCAGCCAAAACAATTTA | 99 | 2529 |
| 876091 | 1472 | 1491 | 35419 | 35438 | TCAGGAGAATGTATATGCTT | 47 | 2530 |
| 876115 | 1613 | 1632 | 37662 | 37681 | GCCTCCAGCTGCACTGGTAA | 58 | 2531 |
| 876139 | 2223 | 2242 | 56231 | 56250 | GTAATCATCCATAGCTACTT | 31 | 2532 |
| 876163 | 2867 | 2886 | 71710 | 71729 | AATACGGCATCTCGGTAAAA | 77 | 2533 |
| 876187 | 3227 | 3246 | 76361 | 76380 | AAGTCCAAATGTGTCAAACT | 44 | 2534 |
| 876211 | 3799 | 3818 | 82144 | 82163 | TGATCTGATTATGGCTAAAT | 49 | 2535 |
| 876235 | 4053 | 4072 | 84048 | 84067 | GTCTTTGGCTTTACATCCTA | 48 | 2536 |
| 876259 | 4697 | 4716 | 92120 | 92139 | TTTTCAAGTTCTACATAGCA | 59 | 2537 |
| 876283 | 5045 | 5064 | 98193 | 98212 | TGTGACATGTAGTTCTTTGG | 38 | 2538 |
| 876307 | 5251 | 5270 | 99257 | 99276 | GTGAAATCTCAAGTAATCGA | 74 | 2539 |
| 876331 | 5651 | 5670 | 101289 | 101308 | ATGGTGAGCCTTGGTTGATC | 57 | 2540 |
| 876355 | 6160 | 6179 | 118493 | 118512 | TGCCGTAGTCAGCAATCTTT | 86 | 2541 |
| 876379 | 6821 | 6840 | 132531 | 132550 | TTTTCTAGGGTATGTCTCTT | 88 | 2542 |
| 876403 | 7579 | 7598 | N/A | N/A | AGCAAGATTGTATCTCTTTC | 78 | 2543 |
| 876427 | 8599 | 8618 | 146768 | 146787 | AATGATGTAGGATCTGCAGC | 65 | 2544 |
| 876451 | N/A | N/A | 3760 | 3779 | AATGAGTTGAAGTGAAAACA | 130 | 2545 |
| 876475 | N/A | N/A | 6080 | 6099 | TATCAACAGATTAACAAAGA | 111 | 2546 |
| 876499 | N/A | N/A | 7975 | 7994 | TTGGTGAAGCAACAGTATCA | 42 | 2547 |
| 876523 | N/A | N/A | 10994 | 11013 | TACAGATGTGCTGAAAGTTA | 112 | 2548 |
| 876547 | N/A | N/A | 14093 | 14112 | TAAAACCAATGTATTGAATG | 84 | 2549 |

TABLE 33-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876571 | N/A | N/A | 16270 | 16289 | ATAACTGTGTTCTACTTTTC | 82 | 2550 |
| 876595 | N/A | N/A | 18575 | 18594 | AGACTTAAAAATGAAAGACA | 106 | 2551 |
| 876619 | N/A | N/A | 20584 | 20603 | AAAATATAAGTCTTAGGGAC | 89 | 2552 |
| 876643 | N/A | N/A | 23603 | 23622 | GTGCCTAAAAAGAATGTAT | 49 | 2553 |
| 876667 | N/A | N/A | 26400 | 26419 | AGTAGCATTTCCCTGATCAC | 49 | 2554 |
| 876691 | N/A | N/A | 29101 | 29120 | AAAAAAAACCTAATAGACG | 118 | 2555 |
| 876715 | N/A | N/A | 30926 | 30945 | AAATATCTCTAACAACAATT | 88 | 2556 |
| 876739 | N/A | N/A | 33082 | 33101 | GTAGCCATTTTTTCTAAAAA | 51 | 2557 |
| 876763 | N/A | N/A | 34583 | 34602 | TAATGATTAAGGAATAATTT | 124 | 2558 |
| 876787 | N/A | N/A | 36936 | 36955 | ATCAGAACCATGTTCTCACT | 95 | 2559 |
| 876811 | N/A | N/A | 38784 | 38803 | CTATCATCCTCTGCACCACA | 96 | 2560 |
| 876835 | N/A | N/A | 41037 | 41056 | CCCTCCTCCAACTTTCAGTC | 89 | 2561 |
| 876859 | N/A | N/A | 43022 | 43041 | TATGTCTTTATTCTTAACAT | 67 | 2562 |
| 876883 | N/A | N/A | 47044 | 47063 | TATTCAGCTTTCTTTGCTTT | 93 | 2563 |
| 876907 | N/A | N/A | 48276 | 48295 | GATACTTTTAAATCTAATAG | 116 | 2564 |
| 876931 | N/A | N/A | 50755 | 50774 | CTTCTTTTACCTCCAAACCC | 81 | 2565 |
| 876955 | N/A | N/A | 53306 | 53325 | AATGGTGAATAACCATGCTG | 76 | 2566 |
| 876979 | N/A | N/A | 56534 | 56553 | CCTAAAGGACCCTATTACTT | 99 | 2567 |
| 877003 | N/A | N/A | 59266 | 59285 | CAGTGCCCAGGTGGTAATGA | 73 | 2568 |
| 877027 | N/A | N/A | 61418 | 61437 | TCTCTCAGTCTTCAACCTTC | 93 | 2569 |
| 877051 | N/A | N/A | 63467 | 63486 | ATGTGCAAAACACTAGTATC | 74 | 2570 |
| 877075 | N/A | N/A | 66552 | 66571 | ATTGTCAGGAAGCAAATGAT | 60 | 2571 |
| 877099 | N/A | N/A | 68281 | 68300 | TGAAAATATGAATACCTCA | 100 | 2572 |
| 877123 | N/A | N/A | 71767 | 71786 | ACAATTTAACTTACCAAGGA | 152 | 2573 |
| 877147 | N/A | N/A | 73109 | 73128 | GATGAAACTGGCACCAAGAA | 100 | 2574 |
| 877171 | N/A | N/A | 74897 | 74916 | GTGGGTCACCTTTCTTTCTT | 43 | 2575 |
| 877195 | N/A | N/A | 77106 | 77125 | ATCAAAGAGGACTCATTAAT | 116 | 2576 |
| 877219 | N/A | N/A | 79825 | 79844 | CAAATCTACCGTTTCTAGGA | 84 | 2577 |
| 877250 | N/A | N/A | 84428 | 84447 | GTTAACTAGTTGCTATATGA | 54 | 2578 |
| 877274 | N/A | N/A | 87487 | 87506 | ACTCGGAAAGTTTCCCAATT | 63 | 2579 |
| 877298 | N/A | N/A | 89963 | 89982 | GAATAGGAAAGTCTACAAAT | 72 | 2580 |
| 877322 | N/A | N/A | 91301 | 91320 | TAATATCCAGAGTGCCGTTA | 52 | 2581 |
| 877346 | N/A | N/A | 93489 | 93508 | CTTAACTAAACCCAAATTCT | 116 | 2582 |
| 877370 | N/A | N/A | 95491 | 95510 | TCAGACAAGTTGCTCTTGGT | 31 | 2583 |
| 877394 | N/A | N/A | 97213 | 97232 | AAGAGGTTTGTATTTAATTT | 68 | 2584 |

TABLE 33-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877418 | N/A | N/A | 100658 | 100677 | CACTTCATAAGTATTGAAGG | 53 | 2585 |
| 877442 | N/A | N/A | 102464 | 102483 | AATAGTTCTCACCACATAAA | 101 | 2586 |
| 877466 | N/A | N/A | 105201 | 105220 | TCTCATATAGTGCCTTGAAA | 65 | 2587 |
| 877490 | N/A | N/A | 107094 | 107113 | AGTCATGTTCAATAAAAATA | 124 | 2588 |
| 877514 | N/A | N/A | 110289 | 110308 | AGGTGGGAATATTCTAAGTA | 48 | 2589 |
| 877538 | N/A | N/A | 112191 | 112210 | CTACAAAAGTTTACCGAGGA | 67 | 2590 |
| 877562 | N/A | N/A | 114372 | 114391 | GAAAGATTCAGATAATCCTT | 130 | 2591 |
| 877586 | N/A | N/A | 117360 | 117379 | ATAATTTCTCACAAGACTTA | 85 | 2592 |
| 877610 | N/A | N/A | 119341 | 119360 | GTAATTTTACTTACAAATAA | 101 | 2593 |
| 877634 | N/A | N/A | 121663 | 121682 | TAAGAGAAATTTATGAATTA | 108 | 2594 |
| 877658 | N/A | N/A | 124138 | 124157 | AACCTAAAGACATCCAATCA | 86 | 2595 |
| 877682 | N/A | N/A | 127082 | 127101 | CAACAGGACCAAATAGGAAT | 78 | 2596 |
| 877706 | N/A | N/A | 130011 | 130030 | GGGACCCTGAGCTAAGACAT | 99 | 2597 |
| 877730 | N/A | N/A | 134153 | 134172 | AAATGGCCTTAATGTTCTCC | 71 | 2598 |
| 877754 | N/A | N/A | 138408 | 138427 | TTTGTGACTCAAAGCTAATA | 76 | 2599 |
| 877778 | N/A | N/A | 140926 | 140945 | CCATTTTCCCCTTTTAAACA | 79 | 2600 |
| 877802 | N/A | N/A | 143250 | 143269 | AAGACCATCCATATGACACT | 89 | 2601 |
| 877826 | N/A | N/A | 144863 | 144882 | AACAGCTTAACCTTTCTATA | 88 | 2602 |

TABLE 34

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 44 | 222 |
| 876020 | 528 | 547 | 13794 | 13813 | GAGGAGATCTAAGGTCTTCA | 37 | 2603 |
| 876044 | 830 | 849 | 21661 | 21680 | ATGAGGACTTCCACATTATT | 110 | 2604 |
| 876068 | 1161 | 1180 | 29422 | 29441 | ACAGGCTTCCAGCCAAAACA | 15 | 2605 |
| 876092 | 1473 | 1492 | 35420 | 35439 | TTCAGGAGAATGTATATGCT | 93 | 2606 |
| 876116 | 1637 | 1656 | 37686 | 37705 | ATAAAATGTAAAATAGCTCG | 56 | 2607 |
| 876140 | 2262 | 2281 | 56270 | 56289 | ATTCTGATCACACGCTCTCT | 46 | 2608 |
| 876164 | 2869 | 2888 | 71712 | 71731 | GTAATACGGCATCTCGGTAA | 84 | 2609 |
| 876188 | 3228 | 3247 | 76362 | 76381 | CAAGTCCAAATGTGTCAAAC | 97 | 2610 |
| 876212 | 3800 | 3819 | 82145 | 82164 | CTGATCTGATTATGGCTAAA | 66 | 2611 |
| 876236 | 4144 | 4163 | 86639 | 86658 | TTTTACCACTCCCAGTATTT | 76 | 2612 |

TABLE 34-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876260 | 4725 | 4744 | 92148 | 92167 | CACATTTTTACGCTCCGATA | 49 | 2613 |
| 876284 | 5046 | 5065 | 98194 | 98213 | CTGTGACATGTAGTTCTTTG | 65 | 2614 |
| 876308 | 5338 | 5357 | 100190 | 100209 | CTTCAGGAGACCAATTTAAG | 75 | 2615 |
| 876332 | 5652 | 5671 | 101290 | 101309 | AATGGTGAGCCTTGGTTGAT | 126 | 2616 |
| 876356 | 6204 | 6223 | 118537 | 118556 | GCCCTCTGATGTTTTTATCC | 31 | 2617 |
| 876380 | 6826 | 6845 | 132536 | 132555 | TCATCTTTTCTAGGGTATGT | 38 | 2618 |
| 876404 | 7660 | 7679 | 145829 | 145848 | TTTCAGCTAATTCTTTTCTC | 100 | 2619 |
| 876428 | 8683 | 8702 | 146852 | 146871 | GAAAAGTGTTAGATATTTAT | 34 | 2620 |
| 876452 | N/A | N/A | 3761 | 3780 | GAATGAGTTGAAGTGAAAAC | 53 | 2621 |
| 876476 | N/A | N/A | 6208 | 6227 | ATCCAGTAATCTCATCGCTG | 50 | 2622 |
| 876500 | N/A | N/A | 8095 | 8114 | ATTCTGAACAGCTTCTGGTG | 102 | 2623 |
| 876524 | N/A | N/A | 11128 | 11147 | TTTTCCTGGAAACACATTCT | 71 | 2624 |
| 876548 | N/A | N/A | 14203 | 14222 | AAGGGCAGGAATGACCACTA | 127 | 2625 |
| 876572 | N/A | N/A | 16432 | 16451 | GCAATTGAAGAAAGTCTACT | 81 | 2626 |
| 876596 | N/A | N/A | 18903 | 18922 | GTTTCTCCAGCACCAAGCCC | 126 | 2627 |
| 876620 | N/A | N/A | 20690 | 20709 | TTCCAGAAGGGCAACCAATG | 89 | 2628 |
| 876644 | N/A | N/A | 23667 | 23686 | GAACTGGACAAGTTAATCCT | 57 | 2629 |
| 876668 | N/A | N/A | 26426 | 26445 | TGCTGTTCTAGACAATTTGG | 73 | 2630 |
| 876692 | N/A | N/A | 29204 | 29223 | AAGCCTTGGTCAATTATAAA | 131 | 2631 |
| 876716 | N/A | N/A | 30940 | 30959 | CACTTGCCATTATCAAATAT | 100 | 2632 |
| 876740 | N/A | N/A | 33139 | 33158 | TGTATGCAACCTTGGGACCT | 56 | 2633 |
| 876764 | N/A | N/A | 34714 | 34733 | TGGAAAGCATTTACATAGAA | 97 | 2634 |
| 876788 | N/A | N/A | 36957 | 36976 | TGTTAACTGAAACTTGTGCA | 44 | 2635 |
| 876812 | N/A | N/A | 38785 | 38804 | TCTATCATCCTCTGCACCAC | 52 | 2636 |
| 876836 | N/A | N/A | 41061 | 41080 | TAAGGAAGGCAGCCTTGATA | 42 | 2637 |
| 876860 | N/A | N/A | 43045 | 43064 | TTTATAAAAATGTTCACACT | 31 | 2638 |
| 876884 | N/A | N/A | 47090 | 47109 | AATCTCATCCATCTGTAATT | 80 | 2639 |
| 876908 | N/A | N/A | 48315 | 48334 | TACTCTGATTTCCTCATCTT | 66 | 2640 |
| 876932 | N/A | N/A | 50766 | 50785 | CTTTACAATGTCTTCTTTTA | 103 | 2641 |
| 876956 | N/A | N/A | 53309 | 53328 | ATAAATGGTGAATAACCATG | 140 | 2642 |
| 876980 | N/A | N/A | 56543 | 56562 | TGGATAACACCTAAAGGACC | 39 | 2643 |
| 877004 | N/A | N/A | 59276 | 59295 | GTATTTGGAGCAGTGCCCAG | 52 | 2644 |
| 877028 | N/A | N/A | 61596 | 61615 | GTACCTTAACACAGTAAATA | 104 | 2645 |
| 877052 | N/A | N/A | 63476 | 63495 | TAATCTACTATGTGCAAAAC | 53 | 2646 |
| 877076 | N/A | N/A | 66557 | 66576 | TCTACATTGTCAGGAAGCAA | 51 | 2647 |

TABLE 34-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877100 | N/A | N/A | 68445 | 68464 | ATCTCTCACAGATGCAAAAT | 74 | 2648 |
| 877124 | N/A | N/A | 71781 | 71800 | ATAATCACAATTGCACAATT | 107 | 2649 |
| 877148 | N/A | N/A | 73144 | 73163 | GAATCATTAGGTAAATATAT | 107 | 2650 |
| 877172 | N/A | N/A | 74948 | 74967 | AGTGGAGAAGAGAGAAAGAC | 63 | 2651 |
| 877196 | N/A | N/A | 77137 | 77156 | TATCAAAAACAATTTGCTTT | 143 | 2652 |
| 877220 | N/A | N/A | 79895 | 79914 | ACAGTCTCTTTTCTTATCTG | 74 | 2653 |
| 877232 | N/A | N/A | 81609 | 81628 | TTTAGTGTCAATTCTAAAAA | 101 | 2654 |
| 877251 | N/A | N/A | 84464 | 84483 | CAGTAGCTATAATGCTTTAA | 66 | 2655 |
| 877275 | N/A | N/A | 87627 | 87646 | TTTAGATTTCATTTAAGAAA | 69 | 2656 |
| 877299 | N/A | N/A | 89982 | 90001 | AATTACATGTCCAACAAGAG | 35 | 2657 |
| 877323 | N/A | N/A | 91362 | 91381 | AATAAAAGTATCTTCCAAAC | 76 | 2658 |
| 877347 | N/A | N/A | 93509 | 93528 | AAATTCACAAAAGTTTCTGC | 90 | 2659 |
| 877371 | N/A | N/A | 95698 | 95717 | TTTCATATCTCTTTTATCAT | 77 | 2660 |
| 877395 | N/A | N/A | 97239 | 97258 | TTTTGCTTTGTCAAATTCAC | 41 | 2661 |
| 877419 | N/A | N/A | 100725 | 100744 | CTATAATTGAATATACTATT | 33 | 2662 |
| 877443 | N/A | N/A | 102592 | 102611 | ATTAAATCAATCTAATGCAT | 122 | 2663 |
| 877467 | N/A | N/A | 105313 | 105332 | CTCAATCCCCAAGGAGTTTG | 61 | 2664 |
| 877491 | N/A | N/A | 107115 | 107134 | CTTTCACCCTGAACACACAG | 72 | 2665 |
| 877515 | N/A | N/A | 110361 | 110380 | CTCAACCCTCACCCATGCAG | 100 | 2666 |
| 877539 | N/A | N/A | 112217 | 112236 | CCTGCTTATAATCTCTGGTT | 57 | 2667 |
| 877563 | N/A | N/A | 114595 | 114614 | TCTGAAGGCTTACTATTTTA | 72 | 2668 |
| 877587 | N/A | N/A | 117410 | 117429 | ACTACAGCATTTCATGTGAT | 51 | 2669 |
| 877611 | N/A | N/A | 119355 | 119374 | ATGTATAGCCACCTGTAATT | 47 | 2670 |
| 877635 | N/A | N/A | 121814 | 121833 | CTTGGATAATTATCATAATG | 70 | 2671 |
| 877659 | N/A | N/A | 124271 | 124290 | TCTCTTGGGTTCATGCCTGA | 49 | 2672 |
| 877683 | N/A | N/A | 127120 | 127139 | TAAATATTTTGTAGCTCTA | 47 | 2673 |
| 877707 | N/A | N/A | 130019 | 130038 | TGTTTCTAGGGACCCTGAGC | 66 | 2674 |
| 877731 | N/A | N/A | 134194 | 134213 | AAATGTTGAAATTGTTACAA | 68 | 2675 |
| 877755 | N/A | N/A | 138536 | 138555 | AAATGACAATTAGGAGGGTC | 61 | 2676 |
| 877779 | N/A | N/A | 141131 | 141150 | CTTGCAAAACTTTGTTTCAT | 38 | 2677 |
| 877803 | N/A | N/A | 143288 | 143307 | AATTTATACCAGTCTTATGT | 147 | 2678 |
| 877827 | N/A | N/A | 144888 | 144907 | ATTCTTAATTATGTGAGTCT | 75 | 2679 |

TABLE 35

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 17 | 222 |
| 780624 | N/A | N/A | 81630 87887 | 81649 87906 | GCAGCATCATGCAAGCAGCA | 33 | 674 |
| 876021 | 545 | 564 | N/A | N/A | ATTTTACCTGAAGTTAGGAG | 71 | 2680 |
| 876045 | 831 | 850 | 21662 | 21681 | CATGAGGACTTCCACATTAT | 56 | 2681 |
| 876069 | 1229 | 1248 | 29580 | 29599 | TTATTTAGTGCCCAGCATGC | 61 | 2682 |
| 876093 | 1474 | 1493 | 35421 | 35440 | CTTCAGGAGAATGTATATGC | 41 | 2683 |
| 876117 | 1678 | 1697 | 41911 | 41930 | ATTCTGTATCCTCCCTGGAT | 49 | 2684 |
| 876141 | 2267 | 2286 | 56275 | 56294 | CTGTTATTCTGATCACACGC | 25 | 2685 |
| 876165 | 2870 | 2889 | 71713 | 71732 | TGTAATACGGCATCTCGGTA | 24 | 2686 |
| 876189 | 3229 | 3248 | 76363 | 76382 | GCAAGTCCAAATGTGTCAAA | 30 | 2687 |
| 876213 | 3801 | 3820 | 82146 | 82165 | GCTGATCTGATTATGGCTAA | 24 | 2688 |
| 876237 | 4149 | 4168 | 86644 | 86663 | GGTGGTTTTACCACTCCCAG | 31 | 2689 |
| 876261 | 4727 | 4746 | 92150 | 92169 | GGCACATTTTTACGCTCCGA | 10 | 2690 |
| 876285 | 5048 | 5067 | 98196 | 98215 | TACTGTGACATGTAGTTCTT | 18 | 2691 |
| 876309 | 5343 | 5362 | 100195 | 100214 | ATAAGCTTCAGGAGACCAAT | 51 | 2692 |
| 876333 | 5654 | 5673 | 101292 | 101311 | GGAATGGTGAGCCTTGGTTG | 42 | 2693 |
| 876357 | 6244 | 6263 | 124875 | 124894 | CATTTCCTCTGGCAACTTCA | 55 | 2694 |
| 876381 | 6856 | 6875 | 132566 | 132585 | AATTGCAATACAAACAAGTG | 115 | 2695 |
| 876405 | 7723 | 7742 | 145892 | 145911 | ATAATTTTCCTATCCAAAGA | 108 | 2696 |
| 876429 | 8688 | 8707 | 146857 | 146876 | CAACTGAAAAGTGTTAGATA | 67 | 2697 |
| 876453 | N/A | N/A | 4066 | 4085 | ATACTTGGAATAGTCAAGTC | 73 | 2698 |
| 876477 | N/A | N/A | 6274 | 6293 | TAGCACAGCCATGATGAAAC | 74 | 2699 |
| 876501 | N/A | N/A | 8339 | 8358 | TTGGATCTTTTCCAGATTAA | 48 | 2700 |
| 876525 | N/A | N/A | 11354 | 11373 | AAAAGATTTAAAGTTAATGA | 101 | 2701 |
| 876549 | N/A | N/A | 14435 | 14454 | ACTTCAGTGTTTGTCACTTA | 62 | 2702 |
| 876573 | N/A | N/A | 16563 | 16582 | AATTTCTATGATTTCTGGTG | 57 | 2703 |
| 876597 | N/A | N/A | 19215 | 19234 | ACTGAGCTACTTTGTCTTC | 65 | 2704 |
| 876621 | N/A | N/A | 20798 | 20817 | TTGGAGAATGACTTTTGCAT | 77 | 2705 |
| 876645 | N/A | N/A | 23873 | 23892 | TGCATTTCTTTATGAAAACA | 26 | 2706 |
| 876669 | N/A | N/A | 26498 | 26517 | AAAGTTACATATGACATGAC | 99 | 2707 |
| 876693 | N/A | N/A | 29206 | 29225 | AGAAGCCTTGGTCAATTATA | 45 | 2708 |
| 876717 | N/A | N/A | 30957 | 30976 | TAACTATCTCAAATTCTCAC | 64 | 2709 |
| 876741 | N/A | N/A | 33365 | 33384 | GATGTCTAACATATCATATT | 39 | 2710 |
| 876765 | N/A | N/A | 34855 | 34874 | TCACTCAGCTTTTGGGAGT | 60 | 2711 |
| 876789 | N/A | N/A | 37013 | 37032 | TTGACTAGAATGCAGTAGGT | 43 | 2712 |

TABLE 35-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876813 | N/A | N/A | 38806 | 38825 | TGTATCTAGTCTCTCTCCCT | 70 | 2713 |
| 876837 | N/A | N/A | 41246 | 41265 | ATAATGTTTTCCAAACCTAA | 85 | 2714 |
| 876861 | N/A | N/A | 43074 | 43093 | CCATTAATTATTTTAAATAG | 125 | 2715 |
| 876885 | N/A | N/A | 47190 | 47209 | AAATTTCCCTCCAACAAGGT | 78 | 2716 |
| 876909 | N/A | N/A | 48331 | 48350 | ATATTAGAAGTGCAAATACT | 102 | 2717 |
| 876933 | N/A | N/A | 50793 | 50812 | CTTTAAAATCATTCCTTTAC | 143 | 2718 |
| 876957 | N/A | N/A | 53340 | 53359 | TTAGCACATTCTCTGAACTT | 76 | 2719 |
| 876981 | N/A | N/A | 56553 | 56572 | AAGATTAGACTGGATAACAC | 79 | 2720 |
| 877005 | N/A | N/A | 59643 | 59662 | ACATTTAAATAATAATGAAG | 126 | 2721 |
| 877029 | N/A | N/A | 61788 | 61807 | ATCAATGTCAGAATAGCATG | 87 | 2722 |
| 877053 | N/A | N/A | 63610 | 63629 | TGCCAAATTGTCCTCAAAAG | 142 | 2723 |
| 877077 | N/A | N/A | 66573 | 66592 | CTAGAGAAAACATTAATCTA | 125 | 2724 |
| 877101 | N/A | N/A | 68563 | 68582 | AAAATACCTTTACACAAATT | 116 | 2725 |
| 877125 | N/A | N/A | 71841 | 71860 | TTGTTCCTAGCTTTGGCATA | 93 | 2726 |
| 877149 | N/A | N/A | 73151 | 73170 | ATGGAAGGAATCATTAGGTA | 47 | 2727 |
| 877173 | N/A | N/A | 74967 | 74986 | GTATTTAGCAAGGCAAAGAA | 92 | 2728 |
| 877197 | N/A | N/A | 77171 | 77190 | AAATTGCATAAATTCATATG | 114 | 2729 |
| 877221 | N/A | N/A | 79928 | 79947 | CTGTGAAACACAATTTGGGA | 60 | 2730 |
| 877252 | N/A | N/A | 84473 | 84492 | ACATGATGTCAGTAGCTATA | 41 | 2731 |
| 877276 | N/A | N/A | 87718 | 87737 | TTCACACTAAATGGCCCCTG | 81 | 2732 |
| 877300 | N/A | N/A | 90037 | 90056 | TAATTGGATGAATAAATTTT | 132 | 2733 |
| 877324 | N/A | N/A | 91380 | 91399 | TAAGAGGATAGTTTCTACAA | 57 | 2734 |
| 877348 | N/A | N/A | 93609 | 93628 | TGGCTTGAAAACCAAGTCAT | 86 | 2735 |
| 877372 | N/A | N/A | 95700 | 95719 | TCTTTCATATCTCTTTTATC | 68 | 2736 |
| 877396 | N/A | N/A | 97476 | 97495 | TGATCCTTGTCATGGCAGTT | 36 | 2737 |
| 877420 | N/A | N/A | 100797 | 100816 | AATCAACATTTTCTGAATCT | 84 | 2738 |
| 877444 | N/A | N/A | 102597 | 102616 | TTTATATTAAATCAATCTAA | 120 | 2739 |
| 877468 | N/A | N/A | 105335 | 105354 | AAGAGCTCTGCTACTCCATC | 131 | 2740 |
| 877492 | N/A | N/A | 107501 | 107520 | TAAAGAACTTGAGAAGGTGA | 94 | 2741 |
| 877516 | N/A | N/A | 110418 | 110437 | CCACTGTTAACTAACAGTGT | 144 | 2742 |
| 877540 | N/A | N/A | 112261 | 112280 | CTATAGCCACTACTAATCAG | 109 | 2743 |
| 877564 | N/A | N/A | 114597 | 114616 | ATTCTGAAGGCTTACTATTT | 89 | 2744 |
| 877588 | N/A | N/A | 117435 | 117454 | TTCTCTGCCCCATGATGTCA | 75 | 2745 |
| 877612 | N/A | N/A | 119387 | 119406 | GGTGATTTAATTGAGTTGCA | 45 | 2746 |
| 877636 | N/A | N/A | 121878 | 121897 | TAAATGTTCAATGTATTGTT | 70 | 2747 |
| 877660 | N/A | N/A | 124436 | 124455 | GAGAGATGAGTAGAAAGGAG | 92 | 2748 |

TABLE 35-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877684 | N/A | N/A | 127318 | 127337 | GCACATTATCTTTAATAAAT | 84 | 2749 |
| 877708 | N/A | N/A | 130037 | 130056 | ATAACCCATCTCAGGCTCTG | 62 | 2750 |
| 877732 | N/A | N/A | 134431 | 134450 | CTACTGTGTTCAAGATTTTA | 66 | 2751 |
| 877756 | N/A | N/A | 138860 | 138879 | AGCACAGATGGCAAAAAGCT | 77 | 2752 |
| 877780 | N/A | N/A | 141161 | 141180 | GAAATATTATATCTGTAACT | 85 | 2753 |
| 877804 | N/A | N/A | 143352 | 143371 | AATCTGCTTCTCTTGTGGGA | 68 | 2754 |
| 877828 | N/A | N/A | 145005 | 145024 | CAAATACCTTGGAACTGAAT | 109 | 2755 |

TABLE 36

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 49 | 222 |
| 803643 | N/A | N/A | 81635 87892 | 81654 87911 | TCATTGCAGCATCATGCAAG | 53 | 1805 |
| 876025 | 706 | 725 | 18605 | 18624 | TCTCAACAAATTCAGTCAGT | 55 | 2756 |
| 876049 | 836 | 855 | 21667 | 21686 | CCACTCATGAGGACTTCCAC | 55 | 2757 |
| 876073 | 1235 | 1254 | 29586 | 29605 | AGGAGATTATTTAGTGCCCA | 35 | 2758 |
| 876097 | 1478 | 1497 | 35425 | 35444 | GCCACTTCAGGAGAATGTAT | 39 | 2759 |
| 876121 | 1697 | 1716 | 41930 | 41949 | ATATTTAGCTTATGATGAAA | 93 | 2760 |
| 876145 | 2448 | 2467 | 62069 | 62088 | ACCTTTCCCAATGCTTATCG | 57 | 2761 |
| 876169 | 2890 | 2909 | 71733 | 71752 | GCAAATTTGGTGAGCAACGC | 50 | 2762 |
| 876193 | 3294 | 3313 | 76428 | 76447 | ATCAAGATTAGCAATACAAC | 105 | 2763 |
| 876217 | 3807 | 3826 | 82152 | 82171 | CAAGATGCTGATCTGATTAT | 64 | 2764 |
| 876241 | 4309 | 4328 | 87213 | 87232 | TATAGAATTCCTCACGACCT | 85 | 2765 |
| 876265 | 4732 | 4751 | 92155 | 92174 | CAATTGGCACATTTTTACGC | 79 | 2766 |
| 876289 | 5053 | 5072 | 98201 | 98220 | TAAAATACTGTGACATGTAG | 39 | 2767 |
| 876313 | 5446 | 5465 | 100435 | 100454 | CCACAACTTGGCCCAAAAGA | 68 | 2768 |
| 876337 | 5691 | 5710 | 101329 | 101348 | GTCAGCCAAAATCAAGTCAG | 48 | 2769 |
| 876361 | 6380 | 6399 | 125011 | 125030 | GGTAATTTTCCTTGTATTTC | 57 | 2770 |
| 876385 | 6998 | 7017 | 137402 | 137421 | GGAGTACTGACATTTCCTAT | 46 | 2771 |
| 876409 | 7903 | 7922 | 146072 | 146091 | ATAAGAAATATAACATTGTG | 99 | 2772 |
| 876433 | 8823 | 8842 | 146992 | 147011 | CCTCAAATTATTACATAGGT | 60 | 2773 |
| 876457 | N/A | N/A | 4255 | 4274 | TAAGACATCACTTTCTTTAG | 58 | 2774 |

TABLE 36-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876481 | N/A | N/A | 6920 | 6939 | GAATCAAATATTGGCTGTGC | 115 | 2775 |
| 876505 | N/A | N/A | 8749 | 8768 | CATATATGTACCCTCTAGAG | 88 | 2776 |
| 876529 | N/A | N/A | 11687 | 11706 | CTGATACATAGAATTACAGA | 70 | 2777 |
| 876553 | N/A | N/A | 14518 | 14537 | GCCAAAGTTTTCTCAGGGAA | 54 | 2778 |
| 876577 | N/A | N/A | 16867 | 16886 | GGGCCCACATAAATCATTCT | 113 | 2779 |
| 876601 | N/A | N/A | 19369 | 19388 | CTCTCCACTCCATGTCTCTG | 75 | 2780 |
| 876625 | N/A | N/A | 21104 | 21123 | ACAATAATGTAACATATTTT | 94 | 2781 |
| 876649 | N/A | N/A | 24272 | 24291 | AGCAAACATTTAAAAGCCCA | 52 | 2782 |
| 876673 | N/A | N/A | 26747 | 26766 | CATAATTAGATTACATAGTT | 110 | 2783 |
| 876697 | N/A | N/A | 29480 | 29499 | TTTATGAGAGTCCTACCTGC | 131 | 2784 |
| 876721 | N/A | N/A | 31326 | 31345 | TAGAAGTCCGGAAAAATATA | 106 | 2785 |
| 876745 | N/A | N/A | 33421 | 33440 | TCTTACTCAATAGTCACCTT | 72 | 2786 |
| 876769 | N/A | N/A | 35273 | 35292 | TTAGAATATTAATATAGTCC | 44 | 2787 |
| 876793 | N/A | N/A | 37536 | 37555 | ACTGATCTGATTCAATGGTA | 96 | 2788 |
| 876817 | N/A | N/A | 38963 | 38982 | CAGAACAAAGTATCATCCCT | 88 | 2789 |
| 876841 | N/A | N/A | 41339 | 41358 | CTTTATTAAGCTACACTGTA | 82 | 2790 |
| 876865 | N/A | N/A | 43282 | 43301 | AGATAAATTTAACCCATTAC | 95 | 2791 |
| 876889 | N/A | N/A | 47322 | 47341 | ACGAATCATGCCACAGTGAA | 95 | 2792 |
| 876913 | N/A | N/A | 48676 | 48695 | TACTAGAACACAGTGAAATG | 119 | 2793 |
| 876937 | N/A | N/A | 51449 | 51468 | AATACATAGTCTCCCTTGAC | 95 | 2794 |
| 876961 | N/A | N/A | 53597 | 53616 | ATTCTTAATCTCCCGTGAAC | 74 | 2795 |
| 876985 | N/A | N/A | 56874 | 56893 | CATGGTTCAGGAGGGAAGAG | 107 | 2796 |
| 877009 | N/A | N/A | 59869 | 59888 | TCCTTGGAGGATCCAAACTA | 99 | 2797 |
| 877033 | N/A | N/A | 62406 | 62425 | TCATAAAGAACTTAAATGTC | 135 | 2798 |
| 877057 | N/A | N/A | 64411 | 64430 | ATGGGAAATTATCCCGAAGC | 133 | 2799 |
| 877081 | N/A | N/A | 66847 | 66866 | CAAAATACTTCAACACTTCA | 119 | 2800 |
| 877105 | N/A | N/A | 68855 | 68874 | AATATAACAAAAATCTGATT | 126 | 2801 |
| 877129 | N/A | N/A | 72099 | 72118 | AACCCACACCATTAGGTAGA | 90 | 2802 |
| 877153 | N/A | N/A | 73877 | 73896 | TGCAAAACCAGAGGCACGG | 78 | 2803 |
| 877177 | N/A | N/A | 75128 | 75147 | TTTTAAATCAAATTGGATGA | 143 | 2804 |
| 877201 | N/A | N/A | 77744 | 77763 | CCCCTCTATAGTATACAAAA | 94 | 2805 |
| 877225 | N/A | N/A | 80668 | 80687 | TTAACCTGGAAGCTAAACAG | 149 | 2806 |
| 877256 | N/A | N/A | 84735 | 84754 | TGAGAGGTGATGACAGAGCT | 99 | 2807 |
| 877280 | N/A | N/A | 87905 | 87924 | TGCACAGAAGAGTTCATTGC | 86 | 2808 |
| 877304 | N/A | N/A | 90343 | 90362 | TAAAAGTTGTCTTCAAAGG | 87 | 2809 |

TABLE 36-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877328 | N/A | N/A | 91620 | 91639 | CTTGGTTATTTGTAAAATGT | 37 | 2810 |
| 877352 | N/A | N/A | 93973 | 93992 | TTATGTCAAAGCTACAGAGA | 60 | 2811 |
| 877376 | N/A | N/A | 95796 | 95815 | TTTTCCAAATTCCTTTGTAT | 58 | 2812 |
| 877400 | N/A | N/A | 97827 | 97846 | GAAACAATGAACATCAGTAT | 80 | 2813 |
| 877424 | N/A | N/A | 101020 | 101039 | AACTGCTGCAGACTACCAGA | 82 | 2814 |
| 877448 | N/A | N/A | 102830 | 102849 | AGCATTTAAATTCAACCTAA | 133 | 2815 |
| 877472 | N/A | N/A | 105422 | 105441 | GTAAGGTTGAGAACAAGTGC | 80 | 2816 |
| 877496 | N/A | N/A | 108081 | 108100 | AGTAGATTCTGTTATACAAA | 53 | 2817 |
| 877520 | N/A | N/A | 110838 | 110857 | AAAAGAGATTATGTCAGATT | 86 | 2818 |
| 877544 | N/A | N/A | 112426 | 112445 | GTACTGTCAGAATTAAATTT | 76 | 2819 |
| 877568 | N/A | N/A | 115091 | 115110 | GATTTGTTATTTAAAGTAAG | 166 | 2820 |
| 877592 | N/A | N/A | 117565 | 117584 | ACAGTGTAAAGTTTTCATCT | 58 | 2821 |
| 877616 | N/A | N/A | 119914 | 119933 | GAGTTGCATATGGTTTAGGA | 36 | 2822 |
| 877640 | N/A | N/A | 122283 | 122302 | TTCTCATCCAGTGCACACAT | 81 | 2823 |
| 877664 | N/A | N/A | 124843 | 124862 | CCTGAAAGTAAGCAGATAAA | 141 | 2824 |
| 877688 | N/A | N/A | 127923 | 127942 | AATTCATGCCATTCCAGAAT | 143 | 2825 |
| 877712 | N/A | N/A | 132134 | 132153 | ATAAGAAGATTGTTCCTCTC | 84 | 2826 |
| 877736 | N/A | N/A | 135027 | 135046 | AGAGAAATAAATGCTCATGG | 82 | 2827 |
| 877760 | N/A | N/A | 139725 | 139744 | TATGGAACTTTAAAGAGTTA | 93 | 2828 |
| 877784 | N/A | N/A | 141305 | 141324 | ACTTTACTTACTTTTGGTTA | 81 | 2829 |
| 877808 | N/A | N/A | 143492 | 143511 | AGACTATGATTAAAACAAAC | 88 | 2830 |
| 877832 | N/A | N/A | 145211 | 145230 | ACATCATTGCCCTGTTTGGA | 55 | 2831 |

TABLE 37

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 34 | 222 |
| 876026 | 711 | 730 | 18610 | 18629 | TTTGTTCTCAACAAATTCAG | 45 | 2832 |
| 876050 | 837 | 856 | 21668 | 21687 | GCCACTCATGAGGACTTCCA | 25 | 2833 |
| 876074 | 1236 | 1255 | 29587 | 29606 | AAGGAGATTATTTAGTGCCC | 41 | 2834 |
| 876098 | 1480 | 1499 | 35427 | 35446 | CAGCCACTTCAGGAGAATGT | 33 | 2835 |
| 876122 | 1698 | 1717 | 41931 | 41950 | CATATTTAGCTTATGATGAA | 66 | 2836 |
| 876146 | 2449 | 2468 | 62070 | 62089 | CACCTTTCCCAATGCTTATC | 44 | 2837 |

TABLE 37-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876170 | 2931 | 2950 | 72955 | 72974 | TTCATGATCAAAAATGGGCC | 44 | 2838 |
| 876194 | 3333 | 3352 | 76467 | 76486 | ATCTAAAACCACTGAGGGTC | 59 | 2839 |
| 876218 | 3835 | 3854 | 82180 | 82199 | ACCATAAATATGCTTTTTCA | 36 | 2840 |
| 876242 | 4311 | 4330 | 87215 | 87234 | ACTATAGAATTCCTCACGAC | 45 | 2841 |
| 876266 | 4733 | 4752 | 92156 | 92175 | TCAATTGGCACATTTTTACG | 71 | 2842 |
| 876290 | 5067 | 5086 | 98215 | 98234 | TTTTTCTAGGAGCTTAAAAT | 90 | 2843 |
| 876314 | 5447 | 5466 | 100436 | 100455 | TCCACAACTTGGCCCAAAAG | 75 | 2844 |
| 876338 | 5692 | 5711 | 101330 | 101349 | GGTCAGCCAAAATCAAGTCA | 76 | 2845 |
| 876362 | 6427 | 6446 | 126543 | 126562 | TCTCAACCATAGGCCATGGG | 36 | 89 |
| 876386 | 7041 | 7060 | 137445 | 137464 | ATTTCTTTCCGTTGAATTTG | 71 | 2846 |
| 876410 | 7993 | 8012 | 146162 | 146181 | ATCGGCCTTATAAATTTTAG | 56 | 2847 |
| 876434 | 8862 | 8881 | 147031 | 147050 | AAGAATTTACCGAAAGTACT | 88 | 2848 |
| 876458 | N/A | N/A | 4345 | 4364 | AAATTTCTGGGTTTCCTATG | 78 | 2849 |
| 876482 | N/A | N/A | 7014 | 7033 | AGCTCTTTGATCCTCAGTGA | 43 | 2850 |
| 876506 | N/A | N/A | 8763 | 8782 | AAAAAGAGAAAGTGCATATA | 97 | 2851 |
| 876530 | N/A | N/A | 11858 | 11877 | TGTACAGGAATATGACTAGA | 73 | 2852 |
| 876554 | N/A | N/A | 14745 | 14764 | TCCAGCCTCTCTCATGCTAT | 94 | 2853 |
| 876578 | N/A | N/A | 16881 | 16900 | TGATAACTGACACAGGGCCC | 91 | 2854 |
| 876602 | N/A | N/A | 19380 | 19399 | GGCCCTTCATGCTCTCCACT | 81 | 2855 |
| 876626 | N/A | N/A | 21285 | 21304 | AGATAAATAAATTGGAGGGT | 76 | 2856 |
| 876650 | N/A | N/A | 24302 | 24321 | ATATTTTTAAGCCCACATTG | 83 | 2857 |
| 876674 | N/A | N/A | 27099 | 27118 | TCATCAACGGCCTCACAATC | 114 | 2858 |
| 876698 | N/A | N/A | 29500 | 29519 | AATTTTGAATAACTCTAATA | 115 | 2859 |
| 876722 | N/A | N/A | 31348 | 31367 | ATGTCATGTGTGAGTTTACA | 46 | 2860 |
| 876746 | N/A | N/A | 33423 | 33442 | GGTCTTACTCAATAGTCACC | 55 | 2861 |
| 876770 | N/A | N/A | 35317 | 35336 | ACTTATAGATATGAAAGCAT | 86 | 2862 |
| 876794 | N/A | N/A | 37818 | 37837 | AAAGATTTACATTTAGTCGA | 67 | 2863 |
| 876818 | N/A | N/A | 39048 | 39067 | ATATAACTAGAGAAAATGAT | 118 | 2864 |
| 876842 | N/A | N/A | 41389 | 41408 | AAGTTCTGTAAAGGCTATAT | 65 | 2865 |
| 876866 | N/A | N/A | 43424 | 43443 | AAAGAAAAGAACCAAGGTTT | 67 | 2866 |
| 876890 | N/A | N/A | 47351 | 47370 | GCATTTAGTTTGTTGCCACA | 30 | 2867 |
| 876914 | N/A | N/A | 48782 | 48801 | CTAATAAAGTGGATGGATTT | 117 | 2868 |
| 876938 | N/A | N/A | 51461 | 51480 | TATCATCTTAATAATACATA | 66 | 2869 |
| 876962 | N/A | N/A | 53654 | 53673 | CTCTTGAAGAAAAACTATTT | 96 | 2870 |
| 876986 | N/A | N/A | 56900 | 56919 | AGAACAATCAGATAGATATA | 105 | 2871 |

TABLE 37-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877010 | N/A | N/A | 59885 | 59904 | TTTGTGGAAGGAATTTTCCT | 73 | 2872 |
| 877034 | N/A | N/A | 62466 | 62485 | GTACCCCTTCAAAAAGCTTC | 97 | 2873 |
| 877058 | N/A | N/A | 64464 | 64483 | CACTATACCCATATACCCAA | 84 | 2874 |
| 877082 | N/A | N/A | 67017 | 67036 | GAAAACTGCATTTCACCAAG | 67 | 2875 |
| 877106 | N/A | N/A | 69629 | 69648 | TTATCCAGAAAATCTCCAAA | 99 | 2876 |
| 877130 | N/A | N/A | 72373 | 72392 | TCCATAGTTCCAAAACAGAC | 76 | 2877 |
| 877154 | N/A | N/A | 73916 | 73935 | CAAAGATGCTCCTGAACATC | 87 | 2878 |
| 877178 | N/A | N/A | 75204 | 75223 | CACTGGGAATAGACAGAAAC | 68 | 2879 |
| 877202 | N/A | N/A | 77774 | 77793 | GGTTTTGACAAGTGTACCAT | 57 | 2880 |
| 877226 | N/A | N/A | 80802 | 80821 | ACCAATAGTGTGTCACTTAA | 48 | 2881 |
| 877233 | N/A | N/A | 81930 | 81949 | ACTAGCATTATTGACATATG | 98 | 2882 |
| 877257 | N/A | N/A | 84787 | 84806 | TAGTGAGTGAACACAGCCAT | 48 | 2883 |
| 877281 | N/A | N/A | 87933 | 87952 | TCCTGACACAAGCTTTTTAA | 64 | 2884 |
| 877305 | N/A | N/A | 90378 | 90397 | CTGGTATTTCTCAAAGCATT | 40 | 2885 |
| 877329 | N/A | N/A | 91655 | 91674 | TTTTAAATATTCAAGGTAAA | 96 | 2886 |
| 877353 | N/A | N/A | 94061 | 94080 | AATGTGCAACAAAGAATTAT | 74 | 2887 |
| 877377 | N/A | N/A | 95892 | 95911 | CATTATCTTGACTTTATCAC | 78 | 2888 |
| 877401 | N/A | N/A | 98295 | 98314 | TAGCAATTAATTTTTTAAGG | 95 | 2889 |
| 877425 | N/A | N/A | 101246 | 101265 | AGAAGTAATAAAACATTTTT | 140 | 2890 |
| 877449 | N/A | N/A | 103447 | 103466 | GGGAGAGTAATCACAAACAT | 76 | 2891 |
| 877473 | N/A | N/A | 105724 | 105743 | TCTCCTGTTCAGAAACAAAT | 103 | 2892 |
| 877497 | N/A | N/A | 108130 | 108149 | GTTAGAGCAGTAAGTCATG | 65 | 2893 |
| 877521 | N/A | N/A | 110906 | 110925 | TAAAATTTGAAATGCATGCT | 118 | 2894 |
| 877545 | N/A | N/A | 112696 | 112715 | TACTTAACGAAGATTAAATA | 106 | 2895 |
| 877569 | N/A | N/A | 115659 | 115678 | CAAATGCATACTTGCTTTCG | 71 | 2896 |
| 877593 | N/A | N/A | 117566 | 117585 | AACAGTGTAAAGTTTTCATC | 65 | 2897 |
| 877617 | N/A | N/A | 119915 | 119934 | AGAGTTGCATATGGTTTAGG | 39 | 2898 |
| 877641 | N/A | N/A | 122290 | 122309 | TTCTAAATTCTCATCCAGTG | 61 | 2899 |
| 877665 | N/A | N/A | 125117 | 125136 | ATGATCATCTGTTTAAGGAA | 74 | 2900 |
| 877689 | N/A | N/A | 128242 | 128261 | AGCATAAACAAGAAGGAGAA | 80 | 2901 |
| 877713 | N/A | N/A | 132213 | 132232 | AGTTTTGCCTATCAAGATGA | 82 | 2902 |
| 877737 | N/A | N/A | 135443 | 135462 | CCTAAGCACCCATGAATGAA | 79 | 2903 |
| 877761 | N/A | N/A | 139807 | 139826 | AATCTCTTTTGGGAGATGAG | 81 | 2904 |
| 877785 | N/A | N/A | 141341 | 141360 | TAACCATTCTGAATTGAATA | 86 | 2905 |

TABLE 37-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877809 | N/A | N/A | 143723 | 143742 | AATTATTATCAAAGGAAGAC | 126 | 2906 |
| 877833 | N/A | N/A | 145245 | 145264 | AATTTATGAAACACATAATA | 101 | 2907 |

TABLE 38

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 15 | 222 |
| 803630 | N/A | N/A | 81592 87849 | 81611 87868 | AAAGCCATAGTGTTTGAAGG | 66 | 1792 |
| 876015 | 341 | 360 | 3732 | 3751 | ACCTGCTGCACACTCGCGAC | 39 | 2908 |
| 876039 | 824 | 843 | N/A | N/A | ACTTCCACATTATTGCAAGG | 38 | 2909 |
| 876063 | 1038 | 1057 | 28013 | 28032 | CGCTGAGATCTGCAATGCTG | 66 | 2910 |
| 876087 | 1467 | 1486 | 35414 | 35433 | AGAATGTATATGCTTCTGCA | 75 | 2911 |
| 876111 | 1499 | 1518 | 35446 | 35465 | AGCATTTTACAGCCACTTTC | 50 | 2912 |
| 876135 | 2086 | 2105 | 56020 | 56039 | AAGATGCTGACAATTTGAGG | 66 | 2913 |
| 876159 | 2716 | 2735 | 65554 | 65573 | ATTTAGACAGCACATCTTCA | 76 | 2914 |
| 876183 | 3222 | 3241 | 76356 | 76375 | CAAATGTGTCAAACTCTTCA | 42 | 2915 |
| 876207 | 3752 | 3771 | 82097 | 82116 | CAGTGTGCGGGACCTGGTAG | 52 | 2916 |
| 876231 | 3973 | 3992 | 83968 | 83987 | ATTTCCCCATTTCATTGGGA | 74 | 2917 |
| 876255 | 4604 | 4623 | 88705 | 88724 | CGAAGTTTTGCCAAAGCATC | 37 | 2918 |
| 876279 | 4962 | 4981 | 98110 | 98129 | TTTTGGACAACCTTCCACTT | 51 | 2919 |
| 876303 | 5197 | 5216 | 99203 | 99222 | AAGGCATTTCATATAGTCGG | 31 | 2920 |
| 876327 | 5646 | 5665 | 101284 | 101303 | GAGCCTTGGTTGATCTGGAT | 41 | 2921 |
| 876351 | 6067 | 6086 | N/A | N/A | TGGCTGAGTGGAGGTATCTC | 100 | 2922 |
| 876375 | 6733 | 6752 | 132443 | 132462 | TTTCAACAGGAAGATGCACC | 68 | 2923 |
| 876399 | 7490 | 7509 | 143138 | 143157 | AGCTGTGCTGTCATCATGAC | 77 | 2924 |
| 876423 | 8494 | 8513 | 146663 | 146682 | AAAAATATCACTTGAAGGAC | 76 | 2925 |
| 876447 | N/A | N/A | 3735 | 3754 | TTTACCTGCTGCACACTCGC | 44 | 2926 |
| 876471 | N/A | N/A | 5332 | 5351 | TATACATGTATCAAATAGCA | 56 | 2927 |
| 876495 | N/A | N/A | 7824 | 7843 | ATCTCTCTAAGAGAGAAGGT | 110 | 2928 |
| 876519 | N/A | N/A | 10780 | 10799 | TCTCTTCATGGTTTGAATTC | 72 | 2929 |
| 876543 | N/A | N/A | 13667 | 13686 | AAGTTTGCTTATTTGCATTT | 75 | 2930 |
| 876567 | N/A | N/A | 15828 | 15847 | TAATTTCATGAGTCTCAATC | 89 | 2931 |

TABLE 38-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876591 | N/A | N/A | 17978 | 17997 | CATGTATAAAATTATAGTTT | 72 | 2932 |
| 876615 | N/A | N/A | 20147 | 20166 | CAATGTGGGTGGAAAACAAT | 107 | 2933 |
| 876639 | N/A | N/A | 23039 | 23058 | ATAGACAATGACCCTTGCTC | 38 | 2934 |
| 876663 | N/A | N/A | 26161 | 26180 | TTCTCATGAAAAATAATGAA | 80 | 2935 |
| 876687 | N/A | N/A | 28159 | 28178 | TGAGCTACACAGGACAGAAA | 90 | 2936 |
| 876711 | N/A | N/A | 30793 | 30812 | CAAAAGCATATGCAGCAGAG | 47 | 2937 |
| 876735 | N/A | N/A | 32754 | 32773 | ATCAAAGGAGATTTCCAGGT | 33 | 2938 |
| 876759 | N/A | N/A | 34066 | 34085 | AATAAGTAGTCTATCTTAAG | 101 | 2939 |
| 876783 | N/A | N/A | 36564 | 36583 | TCCGCTGTGTTTTGCCTCA | 65 | 2940 |
| 876807 | N/A | N/A | 38580 | 38599 | ATGCCTCACTCACCCCCGAC | 70 | 2941 |
| 876831 | N/A | N/A | 40880 | 40899 | AAGAAGATGTGACCACTAAA | 122 | 2942 |
| 876855 | N/A | N/A | 42917 | 42936 | GTAATTCCCTTCTTCTCTTT | 47 | 2943 |
| 876879 | N/A | N/A | 46712 | 46731 | AATACTATTGTTATTTTTAC | 126 | 2944 |
| 876903 | N/A | N/A | 48099 | 48118 | CAGGGTGCATAGTCTGTAGG | 49 | 2945 |
| 876927 | N/A | N/A | 50346 | 50365 | TCTGAACTTTCTGTTTGATT | 35 | 2946 |
| 876951 | N/A | N/A | 52863 | 52882 | GCCCTACAAAAATCTATTCT | 53 | 2947 |
| 876975 | N/A | N/A | 56130 | 56149 | GGATGCAAGTGAAAAACACT | 103 | 2948 |
| 876999 | N/A | N/A | 57946 | 57965 | CTAGATATAAATAACCTCTG | 52 | 2949 |
| 877023 | N/A | N/A | 61194 | 61213 | ATAATATCCATCAGTTACTG | 97 | 2950 |
| 877047 | N/A | N/A | 63254 | 63273 | GAAGAGACAGCCAGGTGAAG | 126 | 2951 |
| 877071 | N/A | N/A | 66298 | 66317 | ACAATATTTTGGAACAACTC | 51 | 2952 |
| 877095 | N/A | N/A | 67597 | 67616 | ATAGGTAATATGATTTAATT | 127 | 2953 |
| 877119 | N/A | N/A | 71046 | 71065 | TCATGTTTCATGGTTTCTTT | 31 | 2954 |
| 877143 | N/A | N/A | 72871 | 72890 | GGAAGGAACCATGAAATTTT | 74 | 2955 |
| 877167 | N/A | N/A | 74441 | 74460 | CCTTGAGAATTTAACAATTT | 44 | 2956 |
| 877191 | N/A | N/A | 76594 | 76613 | CTCTTTCTTACCCTTCTAAA | 143 | 2957 |
| 877215 | N/A | N/A | 79222 | 79241 | GCAAAGCAAACAGATTTTGA | 49 | 2958 |
| 877246 | N/A | N/A | 83653 | 83672 | TCACTCATCTGTAATATTAA | 34 | 2959 |
| 877270 | N/A | N/A | 86973 | 86992 | CTAACATATCCCTCCATGTT | 69 | 2960 |
| 877294 | N/A | N/A | 89174 | 89193 | CCATAAAACAGGAATTCCAA | 84 | 2961 |
| 877318 | N/A | N/A | 91036 | 91055 | ATCTCTTAACCCAGAGAATT | 93 | 2962 |
| 877342 | N/A | N/A | 93085 | 93104 | ATATTTGAGACACTGACATG | 107 | 2963 |
| 877366 | N/A | N/A | 95216 | 95235 | AATTACTCCACAGAATCTTC | 104 | 2964 |
| 877390 | N/A | N/A | 96680 | 96699 | AATTCTAACTCTACCTCTTC | 140 | 2965 |
| 877414 | N/A | N/A | 99835 | 99854 | TAAAAGAAGTTTTTGATCA | 100 | 2966 |

TABLE 38-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877438 | N/A | N/A | 102077 | 102096 | ATGTGCAGGAAGTCAAGATA | 63 | 2967 |
| 877462 | N/A | N/A | 104952 | 104971 | GTATTATTTGCATCTTATCA | 57 | 2968 |
| 877486 | N/A | N/A | 106807 | 106826 | AGTGAGTCTTACAAAAAGTT | 73 | 2969 |
| 877510 | N/A | N/A | 110180 | 110199 | GAGAAAAGCACAGATGACTC | 46 | 2970 |
| 877534 | N/A | N/A | 111786 | 111805 | CTCTGCAATTCAAAAAAAGT | 100 | 2971 |
| 877558 | N/A | N/A | 114104 | 114123 | TAGGCAATGAGAGATGATAC | 147 | 2972 |
| 877582 | N/A | N/A | 117147 | 117166 | CAGCTGAAGATTCTCTCTCT | 66 | 2973 |
| 877606 | N/A | N/A | 119182 | 119201 | TCAGGATTGGGAACTAAGAA | 56 | 2974 |
| 877630 | N/A | N/A | 121116 | 121135 | TTCTCTAAACTTTAGTCTCT | 53 | 2975 |
| 877654 | N/A | N/A | 123425 | 123444 | TACTCTTTCAACTGTTCTTT | 61 | 2976 |
| 877678 | N/A | N/A | 126753 | 126772 | GGATGGTGAAAATTATAGGA | 61 | 2977 |
| 877702 | N/A | N/A | 129321 | 129340 | TTCTATATTGCAGAGCCACC | 131 | 2978 |
| 877726 | N/A | N/A | 133413 | 133432 | TTCAGTGGAGTTTAGTTCAG | 81 | 2979 |
| 877750 | N/A | N/A | 138222 | 138241 | CCAAGTTCACAAAACCAATA | 57 | 2980 |
| 877774 | N/A | N/A | 140803 | 140822 | ATGGCAAACTCCTACTTGGC | 97 | 2981 |
| 877798 | N/A | N/A | 142508 | 142527 | TTTTCCCAGAACCAGTGAAT | 102 | 2982 |
| 877822 | N/A | N/A | 144769 | 144788 | TTTGGATATGGTAAGGTACA | 71 | 2983 |

TABLE 39

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 18 | 222 |
| 803628 | N/A | N/A | 81589 87846 | 81608 87865 | GCCATAGTGTTTGAAGGAAT | 43 | 1790 |
| 876012 | 338 | 357 | 3729 | 3748 | TGCTGCACACTCGCGACTCT | 71 | 2984 |
| 876036 | 802 | 821 | 18701 | 18720 | TCGCTAGGGAATGTAAACAA | 63 | 2985 |
| 876060 | 877 | 896 | 21708 | 21727 | CTTTCATAGCTTCCACCACA | 56 | 2986 |
| 876084 | 1450 | 1469 | 35397 | 35416 | GCATTAACTCCAAAACATTC | 32 | 2987 |
| 876108 | 1491 | 1510 | 35438 | 35457 | ACAGCCACTTTCAGCCACTT | 63 | 2988 |
| 876132 | 1957 | 1976 | 52997 | 53016 | CATTCTTCTTTGTAATCAAG | 53 | 2989 |
| 876156 | 2621 | 2640 | N/A | N/A | GCTAGTGTAGATGCTATATT | 26 | 2990 |
| 876180 | 3215 | 3234 | N/A | N/A | GTCAAACTCTTCAGAGTTTC | 21 | 2991 |
| 876204 | 3660 | 3679 | 80940 | 80959 | GGAAAATTTGTTCTGAGATA | 20 | 2992 |

TABLE 39-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876228 | 3924 | 3943 | 83919 | 83938 | ATCCAGAGATGTCAGATTTT | 131 | 2993 |
| 876252 | 4427 | 4446 | N/A | N/A | GCGCGAGCCTTTATATTGAA | 95 | 2994 |
| 876276 | 4816 | 4835 | 92239 | 92258 | CGTGAGGAAGCTCATTTTCA | 30 | 148 |
| 876300 | 5193 | 5212 | 99199 | 99218 | CATTTCATATAGTCGGATGA | 46 | 2995 |
| 876324 | 5571 | 5590 | 100560 | 100579 | TTGATGTTCTTCACCATCAT | 57 | 2996 |
| 876348 | 5984 | 6003 | 113181 | 113200 | TGCTGAAGCAGGCGATCCAA | 97 | 2997 |
| 876372 | 6650 | 6669 | 129795 | 129814 | TCAAGAAATGAGAGCTGTCC | 87 | 2998 |
| 876396 | 7395 | 7414 | 143043 | 143062 | TCCTCCAGTTCCTATCCAAA | 87 | 2999 |
| 876420 | 8397 | 8416 | 146566 | 146585 | ATGTCTAGGAAAGACACAGA | 119 | 3000 |
| 876444 | 9175 | 9194 | 147344 | 147363 | ATTTAAATATGGTATTCATT | 145 | 3001 |
| 876468 | N/A | N/A | 5184 | 5203 | ACTCATAACTACTCCGGACA | 101 | 3002 |
| 876492 | N/A | N/A | 7482 | 7501 | TGGCAGTCTGGAATATCATG | 62 | 3003 |
| 876516 | N/A | N/A | 10656 | 10675 | AATCAAACTTCTGAGTTTAA | 78 | 3004 |
| 876540 | N/A | N/A | 13053 | 13072 | AGCACTACTTATTTTCCAAT | 34 | 3005 |
| 876564 | N/A | N/A | 15510 | 15529 | AGGCACCTTCATTCCTATTG | 63 | 3006 |
| 876588 | N/A | N/A | 17889 | 17908 | TTTTAATTTTATGCCAGAGT | 42 | 3007 |
| 876612 | N/A | N/A | 19937 | 19956 | TTGTGATTTTATAAACATCA | 72 | 3008 |
| 876636 | N/A | N/A | 22628 | 22647 | TTAACCCTTATTTATATATG | 104 | 3009 |
| 876660 | N/A | N/A | 25657<br>25687<br>25717<br>25747<br>25811<br>25875 | 25676<br>25706<br>25736<br>25766<br>25830<br>25894 | TTATATACATCTGTGTATAA | 85 | 3010 |
| 876684 | N/A | N/A | 27860 | 27879 | TTAACATATAACACTATTTA | 119 | 3011 |
| 876708 | N/A | N/A | 30296 | 30315 | CAGAGGATACCCATTGCAAA | 60 | 3012 |
| 876732 | N/A | N/A | 32607 | 32626 | CCTCTTTAACTGCACAGTAG | 38 | 3013 |
| 876756 | N/A | N/A | 33886 | 33905 | AACCTTTCCCAAAGTGGCTA | 56 | 3014 |
| 876780 | N/A | N/A | 36392 | 36411 | TAACCCTACTTCTTACAAGT | 109 | 3015 |
| 876804 | N/A | N/A | 38436 | 38455 | CATCGATATTCTCAAAGCCT | 45 | 3016 |
| 876828 | N/A | N/A | 40375 | 40394 | TACTTAAAATACTTCAAACA | 110 | 3017 |
| 876852 | N/A | N/A | 42387 | 42406 | ACCATATACTATGAGACCAG | 40 | 3018 |
| 876876 | N/A | N/A | 45845 | 45864 | GGAATTACAGTGGAGAGGTT | 107 | 3019 |
| 876900 | N/A | N/A | 48095 | 48114 | GTGCATAGTCTGTAGGTAGT | 28 | 3020 |
| 876924 | N/A | N/A | 50233 | 50252 | GCTCTGTTGTCACCCTTGTA | 62 | 3021 |
| 876948 | N/A | N/A | 52394 | 52413 | CATTAGAAGATGAATTCACT | 104 | 3022 |
| 876972 | N/A | N/A | 55581 | 55600 | ATAATATTGAACAGTAGGTT | 84 | 3023 |
| 876996 | N/A | N/A | 57799 | 57818 | CTGTTGGGTAGAAAGATTTG | 85 | 3024 |

TABLE 39-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877020 | N/A | N/A | 60838 | 60857 | GGTTGGAAGGCACCAATTAA | 76 | 3025 |
| 877044 | N/A | N/A | 63123 | 63142 | AGCCTACTGAGCGGTTGGAA | 82 | 3026 |
| 877068 | N/A | N/A | 66018 | 66037 | GTTGCAGACATTTTACATAC | 32 | 3027 |
| 877092 | N/A | N/A | 67322 | 67341 | TAGAACCATACCTAAATAGT | 97 | 3028 |
| 877116 | N/A | N/A | 70348 | 70367 | GTAATACCCGAAAGAAGGGA | 53 | 3029 |
| 877140 | N/A | N/A | 72680 | 72699 | TGAAAAGCTATATCCATAT | 120 | 3030 |
| 877164 | N/A | N/A | 74213 | 74232 | AAAAAAACTTTCAGTAATC | 142 | 3031 |
| 877188 | N/A | N/A | 76212 | 76231 | AACACAATCCACAACAGAAT | 89 | 3032 |
| 877212 | N/A | N/A | 78681 | 78700 | AGGAGGAAAATACTATCCAA | 59 | 3033 |
| 877243 | N/A | N/A | 83326 | 83345 | TATATGCACAGTTTTGCTGA | 71 | 3034 |
| 877267 | N/A | N/A | 86866 | 86885 | AGAACAGAAAGCTCAGTTTT | 80 | 3035 |
| 877291 | N/A | N/A | 89005 | 89024 | CTCTCAGAAACATTTTCTCA | 66 | 3036 |
| 877315 | N/A | N/A | 90693 | 90712 | AACAAAACTTAAAAGTGTCT | 166 | 3037 |
| 877339 | N/A | N/A | 92828 | 92847 | AAACAACTCACACATTTCTA | 84 | 3038 |
| 877363 | N/A | N/A | 95003 | 95022 | AGTTGAGTTACCTCCTGATA | 72 | 3039 |
| 877387 | N/A | N/A | 96290 | 96309 | TCTGGTTACTAGAATGTAGC | 104 | 3040 |
| 877411 | N/A | N/A | 99458 | 99477 | GATTGCCTACTCCAAGGTTT | 56 | 3041 |
| 877435 | N/A | N/A | 101844 | 101863 | AGGCTTTTAATGAATATTTC | 80 | 3042 |
| 877459 | N/A | N/A | 104859 | 104878 | GGTATTGAGAGAGCTTCAGA | 51 | 3043 |
| 877483 | N/A | N/A | 106692 | 106711 | GAAAAGACAAACTAGGATTG | 70 | 3044 |
| 877507 | N/A | N/A | 109824 | 109843 | GTAGAACAGAGTCTGAAGTA | 67 | 3045 |
| 877531 | N/A | N/A | 111551 | 111570 | CTGTAACTCTGTTGAAATGT | 96 | 3046 |
| 877555 | N/A | N/A | 113739 | 113758 | TCAAAGACCACAGCCTTTCC | 116 | 3047 |
| 877579 | N/A | N/A | 116515 | 116534 | GCTAAGAGACTTCTTTCTTC | 48 | 3048 |
| 877603 | N/A | N/A | 118863 | 118882 | ACTAAAGTTTTTGCTGTTAC | 51 | 3049 |
| 877627 | N/A | N/A | 120815 | 120834 | CGGAAAAGACAAGAAGATAA | 82 | 3050 |
| 877651 | N/A | N/A | 122955 | 122974 | TTATCATGTGAATTAGCATA | 47 | 3051 |
| 877675 | N/A | N/A | 126419 | 126438 | CCAGACATTGCAAAGAAAAA | 65 | 3052 |
| 877699 | N/A | N/A | 129171 | 129190 | AGTGTGAAGGCACCGTAAGA | 73 | 3053 |
| 877723 | N/A | N/A | 133344 | 133363 | CCAATTCCATCCATTGAAAT | 69 | 3054 |
| 877747 | N/A | N/A | 137747 | 137766 | AAAAGTGATTAGGTTGAGTG | 62 | 3055 |
| 877771 | N/A | N/A | 140595 | 140614 | TATTTTCTACATACCCCTCG | 93 | 3056 |
| 877795 | N/A | N/A | 142281 | 142300 | ATCTAAAATGTTCTCAAGAG | 136 | 3057 |
| 877819 | N/A | N/A | 144428 | 144447 | GTTGGCTTCTCAGAGGTTTT | 50 | 3058 |

TABLE 40

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 24 | 222 |
| 803632 | N/A | N/A | 81595 87852 | 81614 87871 | TAAAAAGCCATAGTGTTTGA | 91 | 1794 |
| 876018 | 441 | 460 | 10465 | 10484 | ACCAAGGACTTCCCAATCAT | 69 | 32 |
| 876042 | 828 | 847 | 21659 | 21678 | GAGGACTTCCACATTATTGC | 19 | 3059 |
| 876066 | 1105 | 1124 | 29366 | 29385 | TCTCATTCTTTTCCTCTAAA | 30 | 3060 |
| 876090 | 1471 | 1490 | 35418 | 35437 | CAGGAGAATGTATATGCTTC | 25 | 3061 |
| 876114 | 1580 | 1599 | 37629 | 37648 | CGTTTCATAACTGTTAGTAT | 46 | 3062 |
| 876138 | 2218 | 2237 | 56226 | 56245 | CATCCATAGCTACTTTTGCA | 54 | 3063 |
| 876162 | 2848 | 2867 | 71691 | 71710 | ATTCTCCTACACTAATTGAA | 64 | 3064 |
| 876186 | 3225 | 3244 | 76359 | 76378 | GTCCAAATGTGTCAAACTCT | 20 | 3065 |
| 876210 | 3797 | 3816 | 82142 | 82161 | ATCTGATTATGGCTAAATAA | 48 | 3066 |
| 876234 | 4048 | 4067 | 84043 | 84062 | TGGCTTTACATCCTATATGT | 43 | 3067 |
| 876258 | 4692 | 4711 | 92115 | 92134 | AAGTTCTACATAGCAGTCTG | 34 | 3068 |
| 876282 | 5044 | 5063 | 98192 | 98211 | GTGACATGTAGTTCTTTGGA | 11 | 3069 |
| 876306 | 5201 | 5220 | 99207 | 99226 | AAATAAGGCATTTCATATAG | 56 | 3070 |
| 876330 | 5650 | 5669 | 101288 | 101307 | TGGTGAGCCTTGGTTGATCT | 42 | 3071 |
| 876354 | 6155 | 6174 | 118488 | 118507 | TAGTCAGCAATCTTTGCAAT | 96 | 3072 |
| 876378 | 6782 | 6801 | 132492 | 132511 | ATGACCAGGAGAGTACCAGA | 69 | 3073 |
| 876402 | 7537 | 7556 | 145140 | 145159 | TTTTCCGGTTGTAGCCCAAT | 70 | 3074 |
| 876426 | 8594 | 8613 | 146763 | 146782 | TGTAGGATCTGCAGCATCAC | 60 | 3075 |
| 876450 | N/A | N/A | 3743 | 3762 | ACAATGCCTTTACCTGCTGC | 98 | 3076 |
| 876474 | N/A | N/A | 5889 | 5908 | TACTTCAGCCCAGGATTGCA | 70 | 3077 |
| 876498 | N/A | N/A | 7911 | 7930 | CTACATGGAACTTCTGTGAT | 71 | 3078 |
| 876522 | N/A | N/A | 10992 | 11011 | CAGATGTGCTGAAAGTTAAT | 62 | 3079 |
| 876546 | N/A | N/A | 14076 | 14095 | ATGAGATTTTGAGAGGCAA | 107 | 3080 |
| 876570 | N/A | N/A | 15984 | 16003 | AATTTTTACATGAAGACTGT | 83 | 3081 |
| 876594 | N/A | N/A | 18271 | 18290 | CTAGAGAAAACTGACAGTGA | 80 | 3082 |
| 876618 | N/A | N/A | 20538 | 20557 | AAAGACTCTACCAGAAAAAG | 106 | 3083 |
| 876642 | N/A | N/A | 23590 | 23609 | AATGTATGGTGACTTGACCT | 97 | 3084 |
| 876666 | N/A | N/A | 26378 | 26397 | AACAAAACCACTTCTTCTTC | 69 | 3085 |
| 876690 | N/A | N/A | 28864 | 28883 | TGAAGAGAAAACCACACACT | 50 | 3086 |
| 876714 | N/A | N/A | 30858 | 30877 | TTATAGTTCATTTTTTAAGA | 159 | 3087 |
| 876738 | N/A | N/A | 32945 | 32964 | ACTCCAAAGACAATACAAAA | 102 | 3088 |
| 876762 | N/A | N/A | 34263 | 34282 | CAACTGGCCAATTTTCCTCT | 60 | 3089 |
| 876786 | N/A | N/A | 36893 | 36912 | GATACATTCCTTCTTTTCCA | 50 | 3090 |

TABLE 40-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876810 | N/A | N/A | 38645 | 38664 | CCTTTTCTTTGGGCCTCAGC | 55 | 3091 |
| 876834 | N/A | N/A | 40906 | 40925 | ACTTCTGAGGCTGCCTATTA | 102 | 3092 |
| 876858 | N/A | N/A | 42989 | 43008 | CCAATTCATCTTATGCAAAA | 50 | 3093 |
| 876882 | N/A | N/A | 46918 | 46937 | ATTTCCTGAGCCACCCTTCT | 62 | 3094 |
| 876906 | N/A | N/A | 48113 | 48132 | ATTAAGTACTTGTCCAGGGT | 41 | 3095 |
| 876930 | N/A | N/A | 50500 | 50519 | GACACAGAGAGCTGTGAGCA | 73 | 3096 |
| 876954 | N/A | N/A | 53300 | 53319 | GAATAACCATGCTGACTTTA | 66 | 3097 |
| 876978 | N/A | N/A | 56491 | 56510 | AAGACACAAACAATTGCAAT | 98 | 3098 |
| 877002 | N/A | N/A | 59243 | 59262 | TGATAGAAGTGTTTGGTTTT | 60 | 3099 |
| 877026 | N/A | N/A | 61360 | 61379 | GGTTAGCATGTGAGGTGCCA | 83 | 3100 |
| 877050 | N/A | N/A | 63441 | 63460 | AAGGTTACAACCATGAACAA | 158 | 3101 |
| 877074 | N/A | N/A | 66455 | 66474 | ATATTGCATAACTTAATAGC | 106 | 3102 |
| 877098 | N/A | N/A | 68250 | 68269 | AGAGCATTTTCAACACCTA | 13 | 3103 |
| 877122 | N/A | N/A | 71326 | 71345 | ATAGTCCAGCAGGAAAAAGC | 81 | 3104 |
| 877146 | N/A | N/A | 73085 | 73104 | TGAATAATTGGAGGAAATTC | 98 | 3105 |
| 877170 | N/A | N/A | 74875 | 74894 | CTCTGTCTCCAGATATAAAA | 27 | 3106 |
| 877194 | N/A | N/A | 77081 | 77100 | AATTAGTTGTAAAAATGTAA | 118 | 3107 |
| 877218 | N/A | N/A | 79715 | 79734 | CAGGACACTCCTAGAAGCTG | 44 | 3108 |
| 877249 | N/A | N/A | 84418 | 84437 | TGCTATATGAAATACAGTGT | 58 | 3109 |
| 877273 | N/A | N/A | 87070 | 87089 | GACCATGTTTAGAGAACTAT | 48 | 3110 |
| 877297 | N/A | N/A | 89927 | 89946 | TTACATGACATTACCATCTA | 50 | 3111 |
| 877321 | N/A | N/A | 91204 | 91223 | CAGAATTTCTGCTTAAATTC | 56 | 3112 |
| 877345 | N/A | N/A | 93276 | 93295 | GAAACATGGAATCTAGAACA | 150 | 3113 |
| 877369 | N/A | N/A | 95294 | 95313 | CAAATTAACTTAATTTTTAC | 125 | 3114 |
| 877393 | N/A | N/A | 97092 | 97111 | GCCCAAGGACTTGTCTTACC | 52 | 3115 |
| 877417 | N/A | N/A | 100614 | 100633 | GTATCAAAACATACCTTCCT | 108 | 3116 |
| 877441 | N/A | N/A | 102459 | 102478 | TTCTCACCACATAAATATTT | 67 | 3117 |
| 877465 | N/A | N/A | 105189 | 105208 | CCTTGAAATGTAGTCACTTG | 61 | 3118 |
| 877489 | N/A | N/A | 107021 | 107040 | ACAGAAGGCGAAGTCAGGAG | 90 | 3119 |
| 877513 | N/A | N/A | 110256 | 110275 | GGCCACAGTGATCAGTTTGG | 56 | 3120 |
| 877537 | N/A | N/A | 112156 | 112175 | AAAAAATACATATCATCCCC | 124 | 3121 |
| 877561 | N/A | N/A | 114361 | 114380 | ATAATCCTTTATAATAAGTA | 118 | 3122 |
| 877585 | N/A | N/A | 117351 | 117370 | CACAAGACTTAATGGAGTTA | 61 | 3123 |
| 877609 | N/A | N/A | 119274 | 119293 | AACAAATGCCAACCCCTAAA | 103 | 3124 |
| 877633 | N/A | N/A | 121503 | 121522 | TATAGTATTTATATGGGTGT | 50 | 3125 |
| 877657 | N/A | N/A | 124119 | 124138 | ACAAAGGGAAATGGTTAAAC | 40 | 3126 |

TABLE 40-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877681 | N/A | N/A | 126991 | 127010 | ACGGGCACCCTACAAGAAAT | 117 | 3127 |
| 877705 | N/A | N/A | 129885 | 129904 | AGTAACTTTCCAAATGGTAT | 69 | 3128 |
| 877729 | N/A | N/A | 134033 | 134052 | CTCTGCCCCTTTTCCCAGAC | 83 | 3129 |
| 877753 | N/A | N/A | 138357 | 138376 | TTACCAGGTGCTGGTCATTA | 24 | 3130 |
| 877777 | N/A | N/A | 140907 | 140926 | ATAAAGAAAAATTACGAACA | 79 | 3131 |
| 877801 | N/A | N/A | 142946 | 142965 | TTTACCATTACCTCCCTAGA | 61 | 3132 |
| 877825 | N/A | N/A | 144861 | 144880 | CAGCTTAACCTTTCTATAAA | 60 | 3133 |

TABLE 41

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 16 | 222 |
| 876020 | 528 | 547 | 13794 | 13813 | GAGGAGATCTAAGGTCTTCA | 35 | 2603 |
| 876044 | 830 | 849 | 21661 | 21680 | ATGAGGACTTCCACATTATT | 47 | 2604 |
| 876068 | 1161 | 1180 | 29422 | 29441 | ACAGGCTTCCAGCCAAAACA | 63 | 2605 |
| 876092 | 1473 | 1492 | 35420 | 35439 | TTCAGGAGAATGTATATGCT | 46 | 2606 |
| 876116 | 1637 | 1656 | 37686 | 37705 | ATAAAATGTAAAATAGCTCG | 112 | 2607 |
| 876140 | 2262 | 2281 | 56270 | 56289 | ATTCTGATCACACGCTCTCT | 42 | 2608 |
| 876164 | 2869 | 2888 | 71712 | 71731 | GTAATACGGCATCTCGGTAA | 66 | 2609 |
| 876188 | 3228 | 3247 | 76362 | 76381 | CAAGTCCAAATGTGTCAAAC | 58 | 2610 |
| 876212 | 3800 | 3819 | 82145 | 82164 | CTGATCTGATTATGGCTAAA | 59 | 2611 |
| 876236 | 4144 | 4163 | 86639 | 86658 | TTTTACCACTCCCAGTATTT | 114 | 2612 |
| 876260 | 4725 | 4744 | 92148 | 92167 | CACATTTTACGCTCCGATA | 31 | 2613 |
| 876284 | 5046 | 5065 | 98194 | 98213 | CTGTGACATGTAGTTCTTTG | 39 | 2614 |
| 876308 | 5338 | 5357 | 100190 | 100209 | CTTCAGGAGACCAATTTAAG | 48 | 2615 |
| 876332 | 5652 | 5671 | 101290 | 101309 | AATGGTGAGCCTTGGTTGAT | 57 | 2616 |
| 876356 | 6204 | 6223 | 118537 | 118556 | GCCCTCTGATGTTTTTATCC | 98 | 2617 |
| 876380 | 6826 | 6845 | 132536 | 132555 | TCATCTTTTCTAGGGTATGT | 43 | 2618 |
| 876404 | 7660 | 7679 | 145829 | 145848 | TTTCAGCTAATTCTTTTCTC | 56 | 2619 |
| 876428 | 8683 | 8702 | 146852 | 146871 | GAAAAGTGTTAGATATTTAT | 135 | 2620 |
| 876452 | N/A | N/A | 3761 | 3780 | GAATGAGTTGAAGTGAAAAC | 120 | 2621 |
| 876476 | N/A | N/A | 6208 | 6227 | ATCCAGTAATCTCATCGCTG | 47 | 2622 |

TABLE 41-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876500 | N/A | N/A | 8095 | 8114 | ATTCTGAACAGCTTCTGGTG | 136 | 2623 |
| 876524 | N/A | N/A | 11128 | 11147 | TTTTCCTGGAAACACATTCT | 114 | 2624 |
| 876548 | N/A | N/A | 14203 | 14222 | AAGGGCAGGAATGACCACTA | 72 | 2625 |
| 876572 | N/A | N/A | 16432 | 16451 | GCAATTGAAGAAAGTCTACT | 56 | 2626 |
| 876596 | N/A | N/A | 18903 | 18922 | GTTTCTCCAGCACCAAGCCC | 49 | 2627 |
| 876620 | N/A | N/A | 20690 | 20709 | TTCCAGAAGGGCAACCAATG | 100 | 2628 |
| 876644 | N/A | N/A | 23667 | 23686 | GAACTGGACAAGTTAATCCT | 47 | 2629 |
| 876668 | N/A | N/A | 26426 | 26445 | TGCTGTTCTAGACAATTTGG | 46 | 2630 |
| 876692 | N/A | N/A | 29204 | 29223 | AAGCCTTGGTCAATTATAAA | 91 | 2631 |
| 876716 | N/A | N/A | 30940 | 30959 | CACTTGCCATTATCAAATAT | 84 | 2632 |
| 876740 | N/A | N/A | 33139 | 33158 | TGTATGCAACCTTGGGACCT | 57 | 2633 |
| 876764 | N/A | N/A | 34714 | 34733 | TGGAAAGCATTTACATAGAA | 47 | 2634 |
| 876788 | N/A | N/A | 36957 | 36976 | TGTTAACTGAAACTTGTGCA | 70 | 2635 |
| 876812 | N/A | N/A | 38785 | 38804 | TCTATCATCCTCTGCACCAC | 69 | 2636 |
| 876836 | N/A | N/A | 41061 | 41080 | TAAGGAAGGCAGCCTTGATA | 54 | 2637 |
| 876860 | N/A | N/A | 43045 | 43064 | TTTATAAAATGTTCACACT | 112 | 2638 |
| 876884 | N/A | N/A | 47090 | 47109 | AATCTCATCCATCTGTAATT | 50 | 2639 |
| 876908 | N/A | N/A | 48315 | 48334 | TACTCTGATTTCCTCATCTT | 58 | 2640 |
| 876932 | N/A | N/A | 50766 | 50785 | CTTTACAATGTCTTCTTTTA | 139 | 2641 |
| 876956 | N/A | N/A | 53309 | 53328 | ATAAATGGTGAATAACCATG | 60 | 2642 |
| 876980 | N/A | N/A | 56543 | 56562 | TGGATAACACCTAAAGGACC | 122 | 2643 |
| 877004 | N/A | N/A | 59276 | 59295 | GTATTTGGAGCAGTGCCCAG | 110 | 2644 |
| 877028 | N/A | N/A | 61596 | 61615 | GTACCTTAACACAGTAAATA | 82 | 2645 |
| 877052 | N/A | N/A | 63476 | 63495 | TAATCTACTATGTGCAAAAC | 100 | 2646 |
| 877076 | N/A | N/A | 66557 | 66576 | TCTACATTGTCAGGAAGCAA | 66 | 2647 |
| 877100 | N/A | N/A | 68445 | 68464 | ATCTCTCACAGATGCAAAAT | 82 | 2648 |
| 877124 | N/A | N/A | 71781 | 71800 | ATAATCACAATTGCACAATT | 109 | 2649 |
| 877148 | N/A | N/A | 73144 | 73163 | GAATCATTAGGTAAATATAT | 99 | 2650 |
| 877172 | N/A | N/A | 74948 | 74967 | AGTGGAGAAGAGAGAAAGAC | 92 | 2651 |
| 877196 | N/A | N/A | 77137 | 77156 | TATCAAAAACAATTTGCTTT | 136 | 2652 |
| 877220 | N/A | N/A | 79895 | 79914 | ACAGTCTCTTTTCTTATCTG | 76 | 2653 |
| 877232 | N/A | N/A | 81609 | 81628 | TTTAGTGTCAATTCTAAAAA | 119 | 2654 |
| 877251 | N/A | N/A | 84464 | 84483 | CAGTAGCTATAATGCTTTAA | 80 | 2655 |
| 877275 | N/A | N/A | 87627 | 87646 | TTTAGATTTCATTTAAGAAA | 105 | 2656 |
| 877299 | N/A | N/A | 89982 | 90001 | AATTACATGTCCAACAAGAG | 92 | 2657 |
| 877323 | N/A | N/A | 91362 | 91381 | AATAAAGTATCTTCCAAAC | 91 | 2658 |

TABLE 41-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877347 | N/A | N/A | 93509 | 93528 | AAATTCACAAAAGTTTCTGC | 80 | 2659 |
| 877371 | N/A | N/A | 95698 | 95717 | TTTCATATCTCTTTTATCAT | 97 | 2660 |
| 877395 | N/A | N/A | 97239 | 97258 | TTTTGCTTTGTCAAATTCAC | 45 | 2661 |
| 877419 | N/A | N/A | 100725 | 100744 | CTATAATTGAATATACTATT | 108 | 2662 |
| 877443 | N/A | N/A | 102592 | 102611 | ATTAAATCAATCTAATGCAT | 105 | 2663 |
| 877467 | N/A | N/A | 105313 | 105332 | CTCAATCCCCAAGGAGTTTG | 60 | 2664 |
| 877491 | N/A | N/A | 107115 | 107134 | CTTTCACCCTGAACACACAG | 68 | 2665 |
| 877515 | N/A | N/A | 110361 | 110380 | CTCAACCCTCACCCATGCAG | 93 | 2666 |
| 877539 | N/A | N/A | 112217 | 112236 | CCTGCTTATAATCTCTGGTT | 87 | 2667 |
| 877563 | N/A | N/A | 114595 | 114614 | TCTGAAGGCTTACTATTTTA | 71 | 2668 |
| 877587 | N/A | N/A | 117410 | 117429 | ACTACAGCATTTCATGTGAT | 46 | 2669 |
| 877611 | N/A | N/A | 119355 | 119374 | ATGTATAGCCACCTGTAATT | 93 | 2670 |
| 877635 | N/A | N/A | 121814 | 121833 | CTTGGATAATTATCATAATG | 41 | 2671 |
| 877659 | N/A | N/A | 124271 | 124290 | TCTCTTGGGTTCATGCCTGA | 67 | 2672 |
| 877683 | N/A | N/A | 127120 | 127139 | TAAATATTTTGTAGCTCTA | 83 | 2673 |
| 877707 | N/A | N/A | 130019 | 130038 | TGTTTCTAGGGACCCTGAGC | 58 | 2674 |
| 877731 | N/A | N/A | 134194 | 134213 | AAATGTTGAAATTGTTACAA | 150 | 2675 |
| 877755 | N/A | N/A | 138536 | 138555 | AAATGACAATTAGGAGGGTC | 78 | 2676 |
| 877779 | N/A | N/A | 141131 | 141150 | CTTGCAAAACTTTGTTTCAT | 66 | 2677 |
| 877803 | N/A | N/A | 143288 | 143307 | AATTTATACCAGTCTTATGT | 126 | 2678 |
| 877827 | N/A | N/A | 144888 | 144907 | ATTCTTAATTATGTGAGTCT | 77 | 2679 |

TABLE 42

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 35 | 222 |
| 803640 | N/A | N/A | 81631 87888 | 81650 87907 | TGCAGCATCATGCAAGCAGC | 22 | 1802 |
| 876022 | 547 | 566 | N/A | N/A | TGATTTTACCTGAAGTTAGG | 82 | 3134 |
| 876046 | 832 | 851 | 21663 | 21682 | TCATGAGGACTTCCACATTA | 50 | 3135 |
| 876070 | 1231 | 1250 | 29582 | 29601 | GATTATTTAGTGCCCAGCAT | 47 | 3136 |
| 876094 | 1475 | 1494 | 35422 | 35441 | ACTTCAGGAGAATGTATATG | 58 | 3137 |
| 876118 | 1683 | 1702 | 41916 | 41935 | ATGAAATTCTGTATCCTCCC | 70 | 3138 |

TABLE 42 -continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876142 | 2306 | 2325 | 56314 | 56333 | GCATCTGCTCCCAATAGAAG | 48 | 3139 |
| 876166 | 2871 | 2890 | 71714 | 71733 | CTGTAATACGGCATCTCGGT | 25 | 3140 |
| 876190 | 3231 | 3250 | 76365 | 76384 | GTGCAAGTCCAAATGTGTCA | 15 | 3141 |
| 876214 | 3803 | 3822 | 82148 | 82167 | ATGCTGATCTGATTATGGCT | 76 | 3142 |
| 876238 | 4190 | 4209 | 86685 | 86704 | CCAAGATCTGATTTCTTGGT | 72 | 139 |
| 876262 | 4728 | 4747 | 92151 | 92170 | TGGCACATTTTTACGCTCCG | 26 | 3143 |
| 876286 | 5049 | 5068 | 98197 | 98216 | ATACTGTGACATGTAGTTCT | 24 | 3144 |
| 876310 | 5429 | 5448 | N/A | N/A | AGAATACAGCCTTTTCTACA | 53 | 3145 |
| 876334 | 5655 | 5674 | 101293 | 101312 | TGGAATGGTGAGCCTTGGTT | 41 | 3146 |
| 876358 | 6249 | 6268 | 124880 | 124899 | AATGACATTTCCTCTGGCAA | 69 | 3147 |
| 876382 | 6870 | 6889 | 132580 | 132599 | TTGCTTGGAAAAGGAATTGC | 63 | 3148 |
| 876406 | 7747 | 7766 | 145916 | 145935 | AATAAATATTTACAAGAGGA | 165 | 3149 |
| 876430 | 8774 | 8793 | 146943 | 146962 | GCTATGTAAACAATTTAAGT | 96 | 3150 |
| 876454 | N/A | N/A | 4075 | 4094 | ATTGGGAAGATACTTGGAAT | 86 | 3151 |
| 876478 | N/A | N/A | 6864 | 6883 | ACACAAATCATTTCAAAATG | 80 | 3152 |
| 876502 | N/A | N/A | 8430 | 8449 | GGCACAAGTTTCTTACTCGC | 56 | 3153 |
| 876526 | N/A | N/A | 11515 | 11534 | TCTAATTTGTCTAAATTTAT | 120 | 3154 |
| 876550 | N/A | N/A | 14441 | 14460 | CTCTGCACTTCAGTGTTTGT | 55 | 3155 |
| 876574 | N/A | N/A | 16653 | 16672 | ATCTCAGTTATCAATCTCAG | 51 | 3156 |
| 876598 | N/A | N/A | 19231 | 19250 | ATAACCCCACACCTTTACTG | 239 | 3157 |
| 876622 | N/A | N/A | 20813 | 20832 | CGAGGCTCAACCCCATTGGA | 58 | 3158 |
| 876646 | N/A | N/A | 23976 | 23995 | TATATAATTGCTAGGTAGAG | 52 | 3159 |
| 876670 | N/A | N/A | 26660 | 26679 | TCATTCAGCTACTTTTGAAA | 55 | 3160 |
| 876694 | N/A | N/A | 29232 | 29251 | ACCAACAGAATGAGGTGTGC | 36 | 3161 |
| 876718 | N/A | N/A | 30990 | 31009 | ATTCAAACAAAATGTTAGTA | 125 | 3162 |
| 876742 | N/A | N/A | 33417 | 33436 | ACTCAATAGTCACCTTCTTT | 60 | 3163 |
| 876766 | N/A | N/A | 34874 | 34893 | ATGTGGAGGTATCGACCATT | 32 | 3164 |
| 876790 | N/A | N/A | 37365 | 37384 | CGGGAATTATTTCACTTCAT | 21 | 3165 |
| 876814 | N/A | N/A | 38809 | 38828 | CCTTGTATCTAGTCTCTCTC | 49 | 3166 |
| 876838 | N/A | N/A | 41299 | 41318 | CTACAAGTCAAAAATGTGGT | 71 | 3167 |
| 876862 | N/A | N/A | 43081 | 43100 | ATCATTTCCATTAATTATTT | 72 | 3168 |
| 876886 | N/A | N/A | 47247 | 47266 | CTTAGAATGAAATTGCTGAT | 48 | 3169 |
| 876910 | N/A | N/A | 48381 | 48400 | TGCCAATGTGGAGTTAATTT | 103 | 3170 |
| 876934 | N/A | N/A | 50807 | 50826 | TAATTATTCTCAGTCTTTAA | 110 | 3171 |
| 876958 | N/A | N/A | 53342 | 53361 | TCTTAGCACATTCTCTGAAC | 61 | 3172 |

TABLE 42 -continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876982 | N/A | N/A | 56609 | 56628 | GACACATTTGAAAAGTTATT | 45 | 3173 |
| 877006 | N/A | N/A | 59726 | 59745 | TCTTTAGAATATTCACACAT | 112 | 3174 |
| 877030 | N/A | N/A | 61906 | 61925 | ACTGGCAAATCAAACTTCAT | 104 | 3175 |
| 877054 | N/A | N/A | 63890 | 63909 | AATGTAATCTTTATCAGGAC | 65 | 3176 |
| 877078 | N/A | N/A | 66625 | 66644 | TTGGAAAACAGACACAAAAG | 61 | 3177 |
| 877102 | N/A | N/A | 68600 | 68619 | GGCCTTTGCTGGTGAAGTCT | 39 | 3178 |
| 877126 | N/A | N/A | 71855 | 71874 | GAAATCCCTACCAATTGTTC | 119 | 3179 |
| 877150 | N/A | N/A | 73433 | 73452 | CAATCAGGCTTTCTTCAAGG | 88 | 3180 |
| 877174 | N/A | N/A | 75007 | 75026 | TGATGAAGTGACAGTTAAAT | 116 | 3181 |
| 877198 | N/A | N/A | 77396 | 77415 | GTACAACTTAGAGGGCCTGG | 38 | 3182 |
| 877222 | N/A | N/A | 80337 | 80356 | AGTTCTCAATACTCTGGTAT | 35 | 3183 |
| 877253 | N/A | N/A | 84478 | 84497 | ATTTCACATGATGTCAGTAG | 61 | 3184 |
| 877277 | N/A | N/A | 87800 | 87819 | AGATAGAAAAGCAACAAAAG | 153 | 3185 |
| 877301 | N/A | N/A | 90174 | 90193 | CAACAAGTCTTTTAAAGAT | 74 | 3186 |
| 877325 | N/A | N/A | 91493 | 91512 | AACATCAGTGATTCTGATAG | 136 | 3187 |
| 877349 | N/A | N/A | 93656 | 93675 | GGATCTAGTAAAGCAGCATG | 39 | 3188 |
| 877373 | N/A | N/A | 95702 | 95721 | TCTCTTTCATATCTCTTTTA | 42 | 3189 |
| 877397 | N/A | N/A | 97648 | 97667 | GAATAGGAAGACAGACTGTG | 69 | 3190 |
| 877421 | N/A | N/A | 100889 | 100908 | TCTTTATAACAGTTCTATGA | 99 | 3191 |
| 877445 | N/A | N/A | 102737 | 102756 | GACAACTTTTTGCTAATAAT | 70 | 3192 |
| 877469 | N/A | N/A | 105355 | 105374 | TTCAGGCCTCCATACCCTTG | 184 | 3193 |
| 877493 | N/A | N/A | 107755 | 107774 | AGAGAATCCATTTGACTTTG | 37 | 3194 |
| 877517 | N/A | N/A | 110432 | 110451 | GAATACAGGAATAACCACTG | 61 | 3195 |
| 877541 | N/A | N/A | 112355 | 112374 | AACAGTGCACACAGTGTAGT | 46 | 3196 |
| 877565 | N/A | N/A | 114614 | 114633 | CTACTGTCAACACAGTAATT | 72 | 3197 |
| 877589 | N/A | N/A | 117436 | 117455 | CTTCTCTGCCCCATGATGTC | 56 | 3198 |
| 877613 | N/A | N/A | 119406 | 119425 | TTTCTTCTGTGCCAGGCACG | 47 | 3199 |
| 877637 | N/A | N/A | 121914 | 121933 | GCCACTATTAAGTGGTAGAG | 52 | 3200 |
| 877661 | N/A | N/A | 124653 | 124672 | CCAAGGTTGACCACACAGGA | 66 | 3201 |
| 877685 | N/A | N/A | 127508 | 127527 | TCATAAGATTTGACAGCATG | 48 | 3202 |
| 877709 | N/A | N/A | 130133 | 130152 | TTCAGAAACCACATTTCTGC | 123 | 3203 |
| 877733 | N/A | N/A | 134456 | 134475 | CAATCAGCAAGTATTTTCAG | 113 | 3204 |
| 877757 | N/A | N/A | 138991 | 139010 | GTGGTGCTTGGACTGAAATA | 85 | 3205 |
| 877781 | N/A | N/A | 141186 | 141205 | TTGTACTATATCTAAATTTC | 89 | 3206 |

TABLE 42-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877805 | N/A | N/A | 143353 | 143372 | TAATCTGCTTCTCTTGTGGG | 71 | 3207 |
| 877829 | N/A | N/A | 145054 | 145073 | ATATTAAACTGGCCTGAAAA | 145 | 3208 |

TABLE 43

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 49 | 222 |
| 803641 | N/A | N/A | 81632 87889 | 81651 87908 | TTGCAGCATCATGCAAGCAG | 57 | 1803 |
| 876023 | 662 | 681 | 16182 | 16201 | AGCACATGTAAAGCTTTGCA | 51 | 3209 |
| 876047 | 833 | 852 | 21664 | 21683 | CTCATGAGGACTTCCACATT | 60 | 3210 |
| 876071 | 1232 | 1251 | 29583 | 29602 | AGATTATTTAGTGCCCAGCA | 43 | 3211 |
| 876095 | 1476 | 1495 | 35423 | 35442 | CACTTCAGGAGAATGTATAT | 35 | 3212 |
| 876119 | 1694 | 1713 | 41927 | 41946 | TTTAGCTTATGATGAAATTC | 36 | 3213 |
| 876143 | 2395 | 2414 | 62016 | 62035 | CACTATTCAGTAAGAGTTCC | 19 | 3214 |
| 876167 | 2873 | 2892 | 71716 | 71735 | CGCTGTAATACGGCATCTCG | 58 | 3215 |
| 876191 | 3250 | 3269 | 76384 | 76403 | ATGATGTAAATTTATTACTG | 75 | 3216 |
| 876215 | 3804 | 3823 | 82149 | 82168 | GATGCTGATCTGATTATGGC | 33 | 3217 |
| 876239 | 4232 | 4251 | 86727 | 86746 | GGCCAGTCTTTCACATCTAT | 39 | 3218 |
| 876263 | 4729 | 4748 | 92152 | 92171 | TTGGCACATTTTTACGCTCC | 21 | 3219 |
| 876287 | 5050 | 5069 | 98198 | 98217 | AATACTGTGACATGTAGTTC | 38 | 3220 |
| 876311 | 5434 | 5453 | N/A | N/A | CCAAAAGAATACAGCCTTTT | 52 | 3221 |
| 876335 | 5660 | 5679 | 101298 | 101317 | GATATTGGAATGGTGAGCCT | 28 | 3222 |
| 876359 | 6288 | 6307 | 124919 | 124938 | TAGTAAACCAAATGAATAAA | 78 | 3223 |
| 876383 | 6953 | 6972 | N/A | N/A | CCTTTAAGCTTAACAGTCTT | 125 | 3224 |
| 876407 | 7856 | 7875 | 146025 | 146044 | TTACTGGTAAGTATTTTTAC | 57 | 3225 |
| 876431 | 8779 | 8798 | 146948 | 146967 | GGTAAGCTATGTAAACAATT | 105 | 3226 |
| 876455 | N/A | N/A | 4112 | 4131 | AACTATTCATAATCTTCTCA | 93 | 3227 |
| 876479 | N/A | N/A | 6910 | 6929 | TTGGCTGTGCAAAAGAAGGA | 112 | 3228 |
| 876503 | N/A | N/A | 8563 | 8582 | CTGCTACATGATAAGGAAGC | 62 | 3229 |
| 876527 | N/A | N/A | 11614 | 11633 | CACACCCTTTATGTACTGAA | 33 | 3230 |
| 876551 | N/A | N/A | 14462 | 14481 | TCTTAGTGGCCAAAGCAACT | 80 | 3231 |
| 876575 | N/A | N/A | 16768 | 16787 | TCACAAGCTCTGTGTCCTCA | 45 | 3232 |

TABLE 43-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876599 | N/A | N/A | 19233 | 19252 | TCATAACCCCACACCTTTAC | 91 | 3233 |
| 876623 | N/A | N/A | 20902 | 20921 | TTTTTTTTGATGTGGAGAAA | 161 | 3234 |
| 876647 | N/A | N/A | 24058 | 24077 | GACTCATGTAAGAAGACAAG | 48 | 3235 |
| 876671 | N/A | N/A | 26694 | 26713 | TTTAATTTTAACTATGAAGA | 101 | 3236 |
| 876695 | N/A | N/A | 29272 | 29291 | TAACAGTTTGACCAACTCTA | 76 | 3237 |
| 876719 | N/A | N/A | 30991 | 31010 | AATTCAAACAAAATGTTAGT | 180 | 3238 |
| 876743 | N/A | N/A | 33419 | 33438 | TTACTCAATAGTCACCTTCT | 62 | 3239 |
| 876767 | N/A | N/A | 34973 | 34992 | TTCCAATACTTAAAACAAGT | 76 | 3240 |
| 876791 | N/A | N/A | 37386 | 37405 | AAGATAGAATTCATAGTAAT | 108 | 3241 |
| 876815 | N/A | N/A | 38831 | 38850 | CCATGGACCTCCAACCCAAT | 86 | 3242 |
| 876839 | N/A | N/A | 41301 | 41320 | CACTACAAGTCAAAATGTG | 62 | 3243 |
| 876863 | N/A | N/A | 43157 | 43176 | ATTTTTAAGGGAGATCTCTC | 56 | 3244 |
| 876887 | N/A | N/A | 47300 | 47319 | TTCATGTCTAATAATCTTTA | 64 | 3245 |
| 876911 | N/A | N/A | 48530 | 48549 | TCTAAAGAAATTCAGACAAC | 115 | 3246 |
| 876935 | N/A | N/A | 50878 | 50897 | CAAAGAAAAAGTCCAATAA | 168 | 3247 |
| 876959 | N/A | N/A | 53439 | 53458 | GCAACCTGCAATAAAACCCA | 43 | 3248 |
| 876983 | N/A | N/A | 56638 | 56657 | AGACTAAGTTGTAGAGATGC | 79 | 3249 |
| 877007 | N/A | N/A | 59787 | 59806 | TAAAATAAATAAATGCCAGC | 125 | 3250 |
| 877031 | N/A | N/A | 62296 | 62315 | ACTAAAAGACTAGTGACTTA | 69 | 3251 |
| 877055 | N/A | N/A | 64013 | 64032 | GAACCCATTTCTGGAGGGTT | 180 | 3252 |
| 877079 | N/A | N/A | 66732 | 66751 | CACTAGAACAGCTAAAAGTA | 172 | 3253 |
| 877103 | N/A | N/A | 68807 | 68826 | TCACTAACAGGATAATTAAA | 103 | 3254 |
| 877127 | N/A | N/A | 72021 | 72040 | TGAAGTGTACTGTAAGTATA | 46 | 3255 |
| 877151 | N/A | N/A | 73765 | 73784 | CTTGAAAGTTACAAGGATAA | 60 | 3256 |
| 877175 | N/A | N/A | 75058 | 75077 | GGTGGGTAGGTTGGCTGGAG | 88 | 3257 |
| 877199 | N/A | N/A | 77450 | 77469 | ACTGAAATGCCACTTTTAAA | 74 | 3258 |
| 877223 | N/A | N/A | 80422 | 80441 | ATGGGTGTTATTTAATAAAA | 65 | 3259 |
| 877254 | N/A | N/A | 84582 | 84601 | AAGTGTAAAGACCAGAAACA | 169 | 3260 |
| 877278 | N/A | N/A | 87864 | 87883 | TAGTCTCCATTCTAAAAAGC | 64 | 3261 |
| 877302 | N/A | N/A | 90291 | 90310 | GACTTATTGGTAATGATATC | 57 | 3262 |
| 877326 | N/A | N/A | 91566 | 91585 | GCAGAGACATAAAATCCCAC | 36 | 3263 |
| 877350 | N/A | N/A | 93891 | 93910 | TTCCATGTGAAATATAAGAA | 79 | 3264 |
| 877374 | N/A | N/A | 95756 | 95775 | AAGGTTAAATTGCCATGTAA | 45 | 3265 |
| 877398 | N/A | N/A | 97666 | 97685 | CTAGGAGAGGACTTCCATGA | 52 | 3266 |
| 877422 | N/A | N/A | 100940 | 100959 | ATTATATGGCAGACATGTTG | 73 | 3267 |

TABLE 43-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877446 | N/A | N/A | 102740 | 102759 | TTGGACAACTTTTTGCTAAT | 72 | 3268 |
| 877470 | N/A | N/A | 105358 | 105377 | ACCTTCAGGCCTCCATACCC | 95 | 3269 |
| 877494 | N/A | N/A | 107793 | 107812 | CCTTTATTTTTATAAATTGA | 51 | 3270 |
| 877518 | N/A | N/A | 110571 | 110590 | TACAGTTGAGTTCTGGTATA | 100 | 3271 |
| 877542 | N/A | N/A | 112357 | 112376 | GAAACAGTGCACACAGTGTA | 56 | 3272 |
| 877566 | N/A | N/A | 114956 | 114975 | AAAAACTAGAACCTAGAGTT | 90 | 3273 |
| 877590 | N/A | N/A | 117469 | 117488 | AGATGTCTATAAAATTCTGA | 77 | 3274 |
| 877614 | N/A | N/A | 119511 | 119530 | AACCAGGCATTGGAATCTGG | 65 | 3275 |
| 877638 | N/A | N/A | 121934 | 121953 | AATTTCTTGATGAACATCAT | 69 | 3276 |
| 877662 | N/A | N/A | 124733 | 124752 | CTAAACCAGGCTGTGTTATT | 75 | 3277 |
| 877686 | N/A | N/A | 127511 | 127530 | TTTTCATAAGATTTGACAGC | 83 | 3278 |
| 877710 | N/A | N/A | 130554 | 130573 | TTTAACCTCAGAACTAATGT | 152 | 3279 |
| 877734 | N/A | N/A | 134509 | 134528 | ATCAGATGTCATTTATCATT | 67 | 3280 |
| 877758 | N/A | N/A | 139025 | 139044 | AGCACAAAGTCACCTAACCT | 50 | 3281 |
| 877782 | N/A | N/A | 141209 | 141228 | TCTATGTGGCTCTTTGTAGA | 50 | 3282 |
| 877806 | N/A | N/A | 143361 | 143380 | AGCTGCAGTAATCTGCTTCT | 33 | 3283 |
| 877830 | N/A | N/A | 145056 | 145075 | ATATATTAAACTGGCCTGAA | 152 | 3284 |

TABLE 44

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 23 | 222 |
| 780625 | N/A | N/A | 81633 87890 | 81652 87909 | ATTGCAGCATCATGCAAGCA | 56 | 675 |
| 876024 | 667 | 686 | 16187 | 16206 | CAAACAGCACATGTAAAGCT | 75 | 3285 |
| 876048 | 834 | 853 | 21665 | 21684 | ACTCATGAGGACTTCCACAT | 42 | 3286 |
| 876072 | 1233 | 1252 | 29584 | 29603 | GAGATTATTTAGTGCCCAGC | 30 | 3287 |
| 876096 | 1477 | 1496 | 35424 | 35443 | CCACTTCAGGAGAATGTATA | 48 | 3288 |
| 876120 | 1696 | 1715 | 41929 | 41948 | TATTTAGCTTATGATGAAAT | 58 | 3289 |
| 876144 | 2400 | 2419 | 62021 | 62040 | AGATCCACTATTCAGTAAGA | 42 | 3290 |
| 876168 | 2874 | 2893 | 71717 | 71736 | ACGCTGTAATACGGCATCTC | 26 | 3291 |
| 876192 | 3289 | 3308 | 76423 | 76442 | GATTAGCAATACAACTCATT | 41 | 3292 |
| 876216 | 3805 | 3824 | 82150 | 82169 | AGATGCTGATCTGATTATGG | 46 | 3293 |

TABLE 44-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876240 | 4237 | 4256 | 86732 | 86751 | GGATAGGCCAGTCTTTCACA | 43 | 3294 |
| 876264 | 4731 | 4750 | 92154 | 92173 | AATTGGCACATTTTTACGCT | 41 | 3295 |
| 876288 | 5052 | 5071 | 98200 | 98219 | AAAATACTGTGACATGTAGT | 26 | 3296 |
| 876312 | 5444 | 5463 | 100433 | 100452 | ACAACTTGGCCCAAAAGAAT | 101 | 3297 |
| 876336 | 5690 | 5709 | 101328 | 101347 | TCAGCCAAAATCAAGTCAGG | 50 | 3298 |
| 876360 | 6293 | 6312 | 124924 | 124943 | TAGAGTAGTAAACCAAATGA | 82 | 3299 |
| 876384 | 6958 | 6977 | N/A | N/A | CAGCTCCTTTAAGCTTAACA | 73 | 3300 |
| 876408 | 7861 | 7880 | 146030 | 146049 | CACATTTACTGGTAAGTATT | 52 | 3301 |
| 876432 | 8818 | 8837 | 146987 | 147006 | AATTATTACATAGGTATTTG | 97 | 3302 |
| 876456 | N/A | N/A | 4226 | 4245 | GGTATACTACAACTAAAGGC | 45 | 3303 |
| 876480 | N/A | N/A | 6916 | 6935 | CAAATATTGGCTGTGCAAAA | 50 | 3304 |
| 876504 | N/A | N/A | 8607 | 8626 | TAAGCCAGATTGTATAAGAA | 91 | 3305 |
| 876528 | N/A | N/A | 11615 | 11634 | ACACACCCTTTATGTACTGA | 35 | 3306 |
| 876552 | N/A | N/A | 14467 | 14486 | CTACCTCTTAGTGGCCAAAG | 58 | 3307 |
| 876576 | N/A | N/A | 16784 | 16803 | TAATTGAACTGTACTGTCAC | 77 | 3308 |
| 876600 | N/A | N/A | 19236 | 19255 | CACTCATAACCCCACACCTT | 68 | 3309 |
| 876624 | N/A | N/A | 20923 | 20942 | TGTTATATTGCTTACCTTTT | 69 | 3310 |
| 876648 | N/A | N/A | 24093 | 24112 | TCAATGGCTCTATTTAACAC | 74 | 3311 |
| 876672 | N/A | N/A | 26696 | 26715 | GTTTTAATTTTAACTATGAA | 63 | 3312 |
| 876696 | N/A | N/A | 29292 | 29311 | CATTATATATATTATCTACT | 94 | 3313 |
| 876720 | N/A | N/A | 30992 | 31011 | AAATTCAAACAAAATGTTAG | 77 | 3314 |
| 876744 | N/A | N/A | 33420 | 33439 | CTTACTCAATAGTCACCTTC | 51 | 3315 |
| 876768 | N/A | N/A | 35168 | 35187 | ACACATGTCATTTCCAATTT | 38 | 3316 |
| 876792 | N/A | N/A | 37410 | 37429 | TAATTGTCTAAACTTTGAAC | 72 | 3317 |
| 876816 | N/A | N/A | 38923 | 38942 | TCACATCAAACAGATCTCCC | 68 | 3318 |
| 876840 | N/A | N/A | 41323 | 41342 | TGTAGCTGAACTATGCTAAA | 118 | 3319 |
| 876864 | N/A | N/A | 43234 | 43253 | TGTATTAAAGTTTGAGTATA | 77 | 3320 |
| 876888 | N/A | N/A | 47312 | 47331 | CCACAGTGAACATTCATGTC | 39 | 3321 |
| 876912 | N/A | N/A | 48595 | 48614 | GTCCAAATATAAAGGCAAAA | 36 | 3322 |
| 876936 | N/A | N/A | 51297 | 51316 | AGAAGTGGTAAGTTAAAAG | 101 | 3323 |
| 876960 | N/A | N/A | 53567 | 53586 | CCAGTATCTTGAATTCCTTA | 38 | 3324 |
| 876984 | N/A | N/A | 56680 | 56699 | TATCAAAACATTAGAACTAT | 86 | 3325 |
| 877008 | N/A | N/A | 59803 | 59822 | GAGAAAGTGAATCTGATAAA | 48 | 3326 |
| 877032 | N/A | N/A | 62335 | 62354 | ATCTTTGGCTTAAGGTCCCT | 54 | 3327 |
| 877056 | N/A | N/A | 64117 | 64136 | TGAAGATTAAAGTAAGCAGG | 46 | 3328 |
| 877080 | N/A | N/A | 66821 | 66840 | AATAAGAATGGCCAATAAGA | 97 | 3329 |

TABLE 44-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877104 | N/A | N/A | 68820 | 68839 | CAGGATAATTAAATCACTAA | 89 | 3330 |
| 877128 | N/A | N/A | 72024 | 72043 | TCTTGAAGTGTACTGTAAGT | 36 | 3331 |
| 877152 | N/A | N/A | 73771 | 73790 | AAATGTCTTGAAAGTTACAA | 58 | 3332 |
| 877176 | N/A | N/A | 75109 | 75128 | ACCGAATGAGAATTAGGTGG | 22 | 3333 |
| 877200 | N/A | N/A | 77633 | 77652 | ATAATTTTGTCTCTTCCAGA | 61 | 3334 |
| 877224 | N/A | N/A | 80461 | 80480 | TATGGTACTAGCTCATAAAG | 87 | 3335 |
| 877255 | N/A | N/A | 84665 | 84684 | TATGAGAAAGTAATAAGACC | 103 | 3336 |
| 877279 | N/A | N/A | 87867 | 87886 | GTTTAGTCTCCATTCTAAAA | 58 | 3337 |
| 877303 | N/A | N/A | 90326 | 90345 | AGGTGATTTATAAGTGCCAA | 28 | 3338 |
| 877327 | N/A | N/A | 91617 | 91636 | GGTTATTTGTAAAATGTTAT | 33 | 3339 |
| 877351 | N/A | N/A | 93895 | 93914 | CATTTTCCATGTGAAATATA | 50 | 3340 |
| 877375 | N/A | N/A | 95790 | 95809 | AAATTCCTTTGTATTTCTCC | 31 | 3341 |
| 877399 | N/A | N/A | 97756 | 97775 | GTCTCATCAATAATATATTC | 46 | 3342 |
| 877423 | N/A | N/A | 100944 | 100963 | TGTTATTATATGGCAGACAT | 66 | 3343 |
| 877447 | N/A | N/A | 102748 | 102767 | CTCAAATTTTGGACAACTTT | 66 | 3344 |
| 877471 | N/A | N/A | 105367 | 105386 | ATGCTTTGTACCTTCAGGCC | 39 | 3345 |
| 877495 | N/A | N/A | 108045 | 108064 | TTAGAAACACTTGAAGTCAT | 61 | 3346 |
| 877519 | N/A | N/A | 110743 | 110762 | AATTAAAATGCCCCCAGGAT | 74 | 3347 |
| 877543 | N/A | N/A | 112384 | 112403 | CTCTGTTTTTATCAGACATT | 49 | 3348 |
| 877567 | N/A | N/A | 115086 | 115105 | GTTATTTAAAGTAAGGTTTC | 52 | 3349 |
| 877591 | N/A | N/A | 117552 | 117571 | TTCATCTCAACCAGGTCTTA | 67 | 3350 |
| 877615 | N/A | N/A | 119913 | 119932 | AGTTGCATATGGTTTAGGAG | 29 | 3351 |
| 877639 | N/A | N/A | 122135 | 122154 | AATATTTACTTCAATATGGA | 68 | 3352 |
| 877663 | N/A | N/A | 124792 | 124811 | CATCCAAGGAGGCATACACT | 78 | 3353 |
| 877687 | N/A | N/A | 127780 | 127799 | TTAAAGGAAAAGTTAACCAG | 75 | 3354 |
| 877711 | N/A | N/A | 132127 | 132146 | GATTGTTCCTCTCCCTCTCC | 57 | 3355 |
| 877735 | N/A | N/A | 134694 | 134713 | TAATGACTAAATAGGAATCT | 89 | 3356 |
| 877759 | N/A | N/A | 139104 | 139123 | GTAGATTTAGTGGTATTGAG | 54 | 3357 |
| 877783 | N/A | N/A | 141286 | 141305 | ACTTTATATTAATTTCTTGT | 67 | 3358 |
| 877807 | N/A | N/A | 143430 | 143449 | TACCATGTATTTCCCATTTT | 61 | 3359 |
| 877831 | N/A | N/A | 145069 | 145088 | TTCTGTTAAAACTATATATT | 128 | 3360 |

TABLE 45

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 16 | 222 |
| 876028 | 732 | 751 | 18631 | 18650 | ACTTAACAATATCATATAAT | 116 | 3361 |
| 876052 | 840 | 859 | 21671 | 21690 | ATTGCCACTCATGAGGACTT | 23 | 3362 |
| 876076 | 1239 | 1258 | 29590 | 29609 | CATAAGGAGATTATTTAGTG | 51 | 3363 |
| 876100 | 1482 | 1501 | 35429 | 35448 | TTCAGCCACTTCAGGAGAAT | 36 | 3364 |
| 876124 | 1701 | 1720 | 41934 | 41953 | AACCATATTTAGCTTATGAT | 35 | 3365 |
| 876148 | 2452 | 2471 | 62073 | 62092 | TGTCACCTTTCCCAATGCTT | 37 | 3366 |
| 876172 | 2977 | 2996 | 73001 | 73020 | GTGAATCATCTGAAGATAAT | 79 | 3367 |
| 876196 | 3422 | 3441 | 76556 | 76575 | TCTACCACATCAGTGAGGTT | 46 | 3368 |
| 876220 | 3850 | 3869 | 82195 | 82214 | GTTTCTCTACTCTAGACCAT | 29 | 3369 |
| 876244 | 4313 | 4332 | 87217 | 87236 | GTACTATAGAATTCCTCACG | 33 | 3370 |
| 876268 | 4736 | 4755 | 92159 | 92178 | AATTCAATTGGCACATTTTT | 80 | 3371 |
| 876292 | 5070 | 5089 | 98218 | 98237 | GAATTTTCTAGGAGCTTAA | 47 | 3372 |
| 876316 | 5450 | 5469 | 100439 | 100458 | TGGTCCACAACTTGGCCCAA | 45 | 3373 |
| 876340 | 5704 | 5723 | 101342 | 101361 | TATTTCTAGGCAGGTCAGCC | 62 | 3374 |
| 876364 | 6471 | 6490 | 126587 | 126606 | AGGCCTTTCTTGAGGATTTT | 56 | 3375 |
| 876388 | 7076 | 7095 | 137480 | 137499 | GAGAAAATCTTTGTGCCACA | 66 | 3376 |
| 876412 | 8045 | 8064 | 146214 | 146233 | ACAGAATTTAAAATAAAGTT | 64 | 3377 |
| 876436 | 8906 | 8925 | 147075 | 147094 | TATCACAGGGAATTATCTGA | 113 | 3378 |
| 876460 | N/A | N/A | 4437 | 4456 | ATCACCTTGGCCTATAATTT | 73 | 3379 |
| 876484 | N/A | N/A | 7124 | 7143 | TTGCTTTTTACTAGCTTGCA | 38 | 3380 |
| 876508 | N/A | N/A | 9022 | 9041 | GGCTCTTTCACATTTCGAAA | 63 | 3381 |
| 876532 | N/A | N/A | 11902 | 11921 | TTTCCTACATAAACTTTTAT | 137 | 3382 |
| 876556 | N/A | N/A | 14858 | 14877 | GTTGAGTACCTTCTTGTTTT | 43 | 3383 |
| 876580 | N/A | N/A | 17001 | 17020 | TCTTGTGTATTATAATTATC | 55 | 3384 |
| 876604 | N/A | N/A | 19521 | 19540 | AGCAATCATTGGTAGCATAC | 17 | 3385 |
| 876628 | N/A | N/A | 21334 | 21353 | GTACTGAAAATGAAAGTCTG | 79 | 3386 |
| 876652 | N/A | N/A | 24857 | 24876 | AAGGTAAGGTCTCAACCAGA | 41 | 3387 |
| 876676 | N/A | N/A | 27470 | 27489 | TCATTGGCATGTTTACCATT | 46 | 3388 |
| 876700 | N/A | N/A | 29725 | 29744 | CTAACAATAAAAGTTACGGT | 49 | 3389 |
| 876724 | N/A | N/A | 31409 | 31428 | AATTTGGTTATAAAAGAGTA | 94 | 3390 |
| 876748 | N/A | N/A | 33425 | 33444 | CAGGTCTTACTCAATAGTCA | 32 | 3391 |
| 876772 | N/A | N/A | 35704 | 35723 | AGCATCAGGTTCAAAAGCAA | 43 | 3392 |
| 876796 | N/A | N/A | 37927 | 37946 | CATTGTAGTTACTTTGTATA | 100 | 3393 |
| 876820 | N/A | N/A | 39204 | 39223 | AAACTATGAATAGGACACCA | 49 | 3394 |
| 876844 | N/A | N/A | 41563 | 41582 | CTGGAAGATTTTTATGCAAC | 66 | 3395 |

TABLE 45-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876868 | N/A | N/A | 45405 | 45424 | CTCTCACAATGAGACAGGAT | 48 | 3396 |
| 876892 | N/A | N/A | 47401 | 47420 | GGTGGAGAAATAAAAATATC | 153 | 3397 |
| 876916 | N/A | N/A | 49326 | 49345 | GATGTCCCTTGTCTATGAGT | 80 | 3398 |
| 876940 | N/A | N/A | 51672 | 51691 | GTCTTTGACCAAAATCTTCT | 53 | 3399 |
| 876964 | N/A | N/A | 54224 | 54243 | CTATCTTGGTTTAATCAGCC | 51 | 3400 |
| 876988 | N/A | N/A | 57012 | 57031 | ATATATTTTCATAGACTGAC | 73 | 3401 |
| 877012 | N/A | N/A | 59950 | 59969 | CATCTTGAAACAGGAAACCC | 90 | 3402 |
| 877036 | N/A | N/A | 62729 | 62748 | GCTTGAAAGTATAAAGAAAA | 92 | 3403 |
| 877060 | N/A | N/A | 64985 | 65004 | GCTAAATAAAGGATCTTGTT | 61 | 3404 |
| 877084 | N/A | N/A | 67063 | 67082 | TCTTAAGTGGGATACAAAAA | 77 | 3405 |
| 877108 | N/A | N/A | 69905 | 69924 | AATTACAACTTCAATATTTC | 117 | 3406 |
| 877132 | N/A | N/A | 72455 | 72474 | CAAAGTGAACCTGAGAATAA | 86 | 3407 |
| 877156 | N/A | N/A | 73937 | 73956 | TCTGTTTCCATTGCCTGCCC | 24 | 3408 |
| 877180 | N/A | N/A | 75325 | 75344 | ATTATTTTGCTTGCTCATTT | 62 | 3409 |
| 877204 | N/A | N/A | 78164 | 78183 | TATCTCAGTATCAGGATGCC | 36 | 3410 |
| 877228 | N/A | N/A | 81375 | 81394 | TACATAAACTTGCCTAATCT | 120 | 3411 |
| 877235 | N/A | N/A | 82381 | 82400 | ATGGAAATCTGGATTTATAG | 48 | 3412 |
| 877259 | N/A | N/A | 84939 | 84958 | TCAGAAAACAAAATCCTTCC | 70 | 3413 |
| 877283 | N/A | N/A | 87993 | 88012 | CATTAAAAAATACCCAAATT | 142 | 3414 |
| 877307 | N/A | N/A | 90438 | 90457 | TCAAACCATTATGCCAGAAT | 34 | 3415 |
| 877331 | N/A | N/A | 91722 | 91741 | AATGTGAAACAGACACGCTA | 53 | 3416 |
| 877355 | N/A | N/A | 94450 | 94469 | AATGTTTCAATATGCTCTTG | 22 | 3417 |
| 877379 | N/A | N/A | 95946 | 95965 | ATTTTAAGCCTCCAAGTTTC | 110 | 3418 |
| 877403 | N/A | N/A | 98420 | 98439 | CAAAATAAATGATACATGTC | 104 | 3419 |
| 877427 | N/A | N/A | 101435 | 101454 | CATCCTAATTTTTATTCTCA | 94 | 3420 |
| 877451 | N/A | N/A | 103549 | 103568 | AGCCAAAATGGCAACAGCTC | 52 | 3421 |
| 877475 | N/A | N/A | 105747 | 105766 | TCATTCCACTTTGATTGTGT | 40 | 3422 |
| 877499 | N/A | N/A | 108438 | 108457 | GGAATTTCTTCAAATTTTG | 102 | 3423 |
| 877523 | N/A | N/A | 111233 | 111252 | TCATAGGCACAGACAGAGGT | 68 | 3424 |
| 877547 | N/A | N/A | 112873 | 112892 | ACTACAGTTGACCTATGGAC | 74 | 3425 |
| 877571 | N/A | N/A | 115802 | 115821 | ATTGCAAGCATAAACAGATT | 98 | 3426 |
| 877595 | N/A | N/A | 118045 | 118064 | ATGAATATTTAACTATTTC | 65 | 3427 |
| 877619 | N/A | N/A | 119984 | 120003 | GCTATTCATGGCTCTGTTGT | 66 | 3428 |
| 877643 | N/A | N/A | 122352 | 122371 | GTTAGAATTTGGAATCACAG | 42 | 3429 |
| 877667 | N/A | N/A | 125287 | 125306 | CAAATGTGGAGTTCTAACAG | 106 | 3430 |

TABLE 45-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877691 | N/A | N/A | 128589 | 128608 | TGGACAAGGTTACTTGGGCA | 55 | 3431 |
| 877715 | N/A | N/A | 132782 | 132801 | TTTATAAATGTCTCAGCTAG | 72 | 3432 |
| 877739 | N/A | N/A | 135635 | 135654 | ATTGCTATAGCCACTACGGA | 102 | 3433 |
| 877763 | N/A | N/A | 140038 | 140057 | CTAGAACTCCAAAAGTCCTA | 76 | 3434 |
| 877787 | N/A | N/A | 141378 | 141397 | ACAAGCTAGACTATTGCAAT | 55 | 3435 |
| 877811 | N/A | N/A | 143863 | 143882 | GAATATATTTTCTTCACCAT | 62 | 3436 |
| 877835 | N/A | N/A | 145294 | 145313 | AAACTACCAATTAAAATTCC | 80 | 3437 |

TABLE 46

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 42 | 222 |
| 876029 | 733 | 752 | 18632 | 18651 | CACTTAACAATATCATATAA | 73 | 3438 |
| 876053 | 841 | 860 | 21672 | 21691 | CATTGCCACTCATGAGGACT | 29 | 3439 |
| 876077 | 1249 | 1268 | 29600 | 29619 | TGTTTTGGTACATAAGGAGA | 60 | 3440 |
| 876101 | 1483 | 1502 | 35430 | 35449 | TTTCAGCCACTTCAGGAGAA | 50 | 3441 |
| 876125 | 1702 | 1721 | 41935 | 41954 | TAACCATATTTAGCTTATGA | 56 | 3442 |
| 876149 | 2453 | 2472 | 62074 | 62093 | CTGTCACCTTTCCCAATGCT | 26 | 3443 |
| 876173 | 3064 | 3083 | 73600 | 73619 | CTAGTGATGTAATATATTCT | 32 | 3444 |
| 876197 | 3427 | 3446 | 76561 | 76580 | GTTTCTCTACCACATCAGTG | 38 | 3445 |
| 876221 | 3852 | 3871 | 82197 | 82216 | CAGTTTCTCTACTCTAGACC | 28 | 3446 |
| 876245 | 4315 | 4334 | 87219 | 87238 | GAGTACTATAGAATTCCTCA | 81 | 3447 |
| 876269 | 4741 | 4760 | 92164 | 92183 | CGGGAAATTCAATTGGCACA | 44 | 3448 |
| 876293 | 5071 | 5090 | 98219 | 98238 | GGAATTTTTCTAGGAGCTTA | 27 | 3449 |
| 876317 | 5451 | 5470 | 100440 | 100459 | GTGGTCCACAACTTGGCCCA | 72 | 152 |
| 876341 | 5745 | 5764 | 101383 | 101402 | TGGAGCTTGTTCAAATTCCA | 52 | 153 |
| 876365 | 6510 | 6529 | 129655 | 129674 | TTCAGCTGAATTCAAAATGT | 82 | 3450 |
| 876389 | 7174 | 7193 | 141535 | 141554 | CCACTGTTATGATGTTGGAA | 65 | 3451 |
| 876413 | 8085 | 8104 | 146254 | 146273 | ATTTCTAGAAAAATCGACAA | 115 | 3452 |
| 876437 | 8911 | 8930 | 147080 | 147099 | TGTCCTATCACAGGGAATTA | 81 | 3453 |
| 876461 | N/A | N/A | 4590 | 4609 | GTCTGTCAAGCCTCTCAACC | 79 | 3454 |
| 876485 | N/A | N/A | 7136 | 7155 | TATCAAACCATTTTGCTTTT | 79 | 3455 |
| 876509 | N/A | N/A | 9076 | 9095 | CAGATTTCTCTAGAATGAAT | 67 | 3456 |

TABLE 46-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876533 | N/A | N/A | 12031 | 12050 | TGTGTCTATCTTCTTCACAA | 119 | 3457 |
| 876557 | N/A | N/A | 14909 | 14928 | AGACTCTTAGTGCATGCCAT | 46 | 3458 |
| 876581 | N/A | N/A | 17076 | 17095 | CCTTAGAAACACAGTAAACT | 72 | 3459 |
| 876605 | N/A | N/A | 19554 19584 | 19573 19603 | AAAACAGAATATGAACCATT | 48 | 3460 |
| 876629 | N/A | N/A | 21340 | 21359 | GGAAAAGTACTGAAAATGAA | 134 | 3461 |
| 876653 | N/A | N/A | 24869 | 24888 | CAGACTCTCTGCAAGGTAAG | 88 | 3462 |
| 876677 | N/A | N/A | 27495 | 27514 | CTTAAAGGAATAGTGCTTAG | 71 | 3463 |
| 876701 | N/A | N/A | 29875 | 29894 | AATTACCAAATGACCCTTGA | 73 | 3464 |
| 876725 | N/A | N/A | 31897 | 31916 | TGGTGTTTACTATGGGTTCC | 28 | 3465 |
| 876749 | N/A | N/A | 33427 | 33446 | TGCAGGTCTTACTCAATAGT | 75 | 3466 |
| 876773 | N/A | N/A | 35778 | 35797 | CACACAATAATTAGAAAAAC | 106 | 3467 |
| 876797 | N/A | N/A | 37999 | 38018 | TCATGGCAACAAAAATAGAA | 129 | 3468 |
| 876821 | N/A | N/A | 39337 | 39356 | TGTCAACTTTAAGGATAATC | 35 | 3469 |
| 876845 | N/A | N/A | 41680 | 41699 | TAAATATAATGTGTAAGAAT | 117 | 3470 |
| 876869 | N/A | N/A | 45530 | 45549 | CACCAACACTCACCATGAAT | 62 | 3471 |
| 876893 | N/A | N/A | 47579 | 47598 | CCCTCAGGGACCTCTACTGA | 59 | 3472 |
| 876917 | N/A | N/A | 49662 | 49681 | ATTTATCAGTGTCTACTTAG | 68 | 3473 |
| 876941 | N/A | N/A | 51782 | 51801 | TTCATTTAGATGATGTTTTG | 95 | 3474 |
| 876965 | N/A | N/A | 54337 | 54356 | ACTCTACTATAGAGATTCTA | 95 | 3475 |
| 876989 | N/A | N/A | 57276 | 57295 | ATTTAATAATGTGTATTAAA | 129 | 3476 |
| 877013 | N/A | N/A | 59957 | 59976 | TACAAACCATCTTGAAACAG | 98 | 3477 |
| 877037 | N/A | N/A | 62733 | 62752 | ATGAGCTTGAAAGTATAAAG | 83 | 3478 |
| 877061 | N/A | N/A | 65104 | 65123 | GTATCAGTGTCCTCACCTGG | 84 | 3479 |
| 877085 | N/A | N/A | 67064 | 67083 | TTCTTAAGTGGGATACAAAA | 81 | 3480 |
| 877109 | N/A | N/A | 69996 | 70015 | ATAGTCCTTAATGTTTGCAC | 46 | 3481 |
| 877133 | N/A | N/A | 72458 | 72477 | TTTCAAAGTGAACCTGAGAA | 83 | 3482 |
| 877157 | N/A | N/A | 73938 | 73957 | ATCTGTTTCCATTGCCTGCC | 69 | 3483 |
| 877181 | N/A | N/A | 75378 | 75397 | CCTTGTCACAGTCTCTTCCA | 56 | 3484 |
| 877205 | N/A | N/A | 78262 | 78281 | AAAACCATTAAATGATTAAT | 148 | 3485 |
| 877229 | N/A | N/A | 81468 | 81487 | AACACACTCAAGATCCAATT | 94 | 3486 |
| 877236 | N/A | N/A | 82634 | 82653 | ATCACACATAATTTGAAATG | 91 | 3487 |
| 877260 | N/A | N/A | 85112 | 85131 | AGTATAATACACTGAAAGCT | 86 | 3488 |
| 877284 | N/A | N/A | 88019 | 88038 | AGCTGTAAAAAAGTTAATAA | 80 | 3489 |
| 877308 | N/A | N/A | 90441 | 90460 | TTTTCAAACCATTATGCCAG | 77 | 3490 |
| 877332 | N/A | N/A | 91728 | 91747 | AAACTTAATGTGAAACAGAC | 77 | 3491 |

TABLE 46-continued

Percent control of human LRRK RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877356 | N/A | N/A | 94452 | 94471 | GCAATGTTTCAATATGCTCT | 13 | 3492 |
| 877380 | N/A | N/A | 96049 | 96068 | GAATGAAGCCAAGTGAATAA | 82 | 3493 |
| 877404 | N/A | N/A | 98444 | 98463 | AGTGTCAGATGCAATGTTTT | 92 | 3494 |
| 877428 | N/A | N/A | 101447 | 101466 | AGGAGAAAATTACATCCTAA | 81 | 3495 |
| 877452 | N/A | N/A | 104028 | 104047 | AAGAGGAAATGTACCCTGTG | 77 | 3496 |
| 877476 | N/A | N/A | 105776 | 105795 | CTCTCTCTCTTGCAAAATTA | 74 | 3497 |
| 877500 | N/A | N/A | 108554 | 108573 | AATTCAAAAGGTCAAATTTT | 105 | 3498 |
| 877524 | N/A | N/A | 111239 | 111258 | TTGTTTTCATAGGCACAGAC | 35 | 3499 |
| 877548 | N/A | N/A | 112899 | 112918 | TTCAGTAATAAAAAGCTGGT | 63 | 3500 |
| 877572 | N/A | N/A | 115808 | 115827 | CAAGGAATTGCAAGCATAAA | 69 | 3501 |
| 877596 | N/A | N/A | 118216 | 118235 | GTCTAATATTACACAGCAAA | 55 | 3502 |
| 877620 | N/A | N/A | 119990 | 120009 | ATATTTGCTATTCATGGCTC | 54 | 3503 |
| 877644 | N/A | N/A | 122379 | 122398 | AGCATATTTTTCTTGATAA | 40 | 3504 |
| 877668 | N/A | N/A | 125297 | 125316 | TAAAAATCACCAAATGTGGA | 85 | 3505 |
| 877692 | N/A | N/A | 128599 | 128618 | GATAATATGGTGGACAAGGT | 38 | 3506 |
| 877716 | N/A | N/A | 132876 | 132895 | GATTCATTGATCTGAGGAGA | 55 | 3507 |
| 877740 | N/A | N/A | 135638 | 135657 | TAAATTGCTATAGCCACTAC | 72 | 3508 |
| 877764 | N/A | N/A | 140071 | 140090 | TTGCCGACCTAGGACTAAAA | 53 | 3509 |
| 877788 | N/A | N/A | 141480 | 141499 | AAAAAATAGAAAGTCATCAC | 128 | 3510 |
| 877812 | N/A | N/A | 143888 | 143907 | TTCCTCTTTCACATATACTT | 77 | 3511 |
| 877836 | N/A | N/A | 145295 | 145314 | TAAACTACCAATTAAAATTC | 139 | 3512 |

TABLE 47

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 31 | 222 |
| 876030 | 734 | 753 | 18633 | 18652 | GCACTTAACAATATCATATA | 34 | 3513 |
| 876054 | 846 | 865 | 21677 | 21696 | CCTGACATTGCCACTCATGA | 38 | 3514 |
| 876078 | 1293 | 1312 | N/A | N/A | AGCTGGGAAATGGCCATCTT | 64 | 3515 |
| 876102 | 1484 | 1503 | 35431 | 35450 | CTTTCAGCCACTTCAGGAGA | 62 | 3516 |
| 876126 | 1704 | 1723 | 41937 | 41956 | TTTAACCATATTTAGCTTAT | 58 | 3517 |
| 876150 | 2454 | 2473 | 62075 | 62094 | GCTGTCACCTTTCCCAATGC | 31 | 3518 |

TABLE 47-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876174 | 3069 | 3088 | 73605 | 73624 | AAGGTCTAGTGATGTAATAT | 43 | 3519 |
| 876198 | 3457 | 3476 | N/A | N/A | TTTTATTTCCTTCTAAAATG | 113 | 3520 |
| 876222 | 3853 | 3872 | 82198 | 82217 | GCAGTTTCTCTACTCTAGAC | 25 | 3521 |
| 876246 | 4316 | 4335 | 87220 | 87239 | TGAGTACTATAGAATTCCTC | 46 | 3522 |
| 876270 | 4751 | 4770 | 92174 | 92193 | CGGTCAATTACGGGAAATTC | 45 | 3523 |
| 876294 | 5073 | 5092 | 98221 | 98240 | CTGGAATTTTTCTAGGAGCT | 13 | 3524 |
| 876318 | 5452 | 5471 | 100441 | 100460 | TGTGGTCCACAACTTGGCCC | 43 | 3525 |
| 876342 | 5787 | 5806 | 106478 | 106497 | TCGGTAAACTGATCCAAAAC | 63 | 3526 |
| 876366 | 6515 | 6534 | 129660 | 129679 | ACTAATTCAGCTGAATTCAA | 67 | 3527 |
| 876390 | 7179 | 7198 | 141540 | 141559 | TACCACCACTGTTATGATGT | 45 | 3528 |
| 876414 | 8090 | 8109 | 146259 | 146278 | TGCAGATTTCTAGAAAAATC | 43 | 3529 |
| 876438 | 8978 | 8997 | 147147 | 147166 | TATAAATAAATTTAAAGTTT | 96 | 3530 |
| 876462 | N/A | N/A | 4609 | 4628 | AAAGATTGAGATGCCTCATG | 73 | 3531 |
| 876486 | N/A | N/A | 7222 | 7241 | GTAGGAGACCCCTTTCTACA | 67 | 3532 |
| 876510 | N/A | N/A | 9202 | 9221 | AATGAAGCTAGAATAATAGA | 118 | 3533 |
| 876534 | N/A | N/A | 12064 | 12083 | GAGTGATCTAATACACTCCA | 93 | 3534 |
| 876558 | N/A | N/A | 14962 | 14981 | CCGTCAAAAAAAAAATACCT | 129 | 3535 |
| 876582 | N/A | N/A | 17310 | 17329 | CTCGCTGCAATACACTTTGT | 66 | 3536 |
| 876606 | N/A | N/A | 19555 19585 | 19574 19604 | CAAAACAGAATATGAACCAT | 84 | 3537 |
| 876630 | N/A | N/A | 21645 | 21664 | TATTGCCTGAATTTAAAGAG | 81 | 3538 |
| 876654 | N/A | N/A | 25038 | 25057 | ACTTTTAAATGCATTGTTGT | 72 | 3539 |
| 876678 | N/A | N/A | 27571 | 27590 | TTTAAAGTTGAAACTCTTAA | 124 | 3540 |
| 876702 | N/A | N/A | 29941 | 29960 | TGAATTAATATGGCATTTTA | 86 | 3541 |
| 876726 | N/A | N/A | 31920 | 31939 | AAACAGAGGAGGAAAGTGAT | 126 | 3542 |
| 876750 | N/A | N/A | 33456 | 33475 | TCAGAGGCAAAAAACAATAT | 67 | 3543 |
| 876774 | N/A | N/A | 35835 | 35854 | CGTTGTGAAAGAGCAAAATT | 50 | 3544 |
| 876798 | N/A | N/A | 38037 | 38056 | GTACAATTCAAACAAGAGAA | 100 | 3545 |
| 876822 | N/A | N/A | 39461 | 39480 | GAAATACTGTATTCAAAACT | 73 | 3546 |
| 876846 | N/A | N/A | 41819 | 41838 | GACTGTTACTTTCTAGAAAT | 93 | 3547 |
| 876870 | N/A | N/A | 45583 | 45602 | GGCTAACTGGAACCAGTTAT | 48 | 3548 |
| 876894 | N/A | N/A | 47597 | 47616 | GACTCTGCTTGTTGTAGTCC | 68 | 3549 |
| 876918 | N/A | N/A | 49701 | 49720 | TAATGTATTGCATTGGTGCT | 62 | 3550 |
| 876942 | N/A | N/A | 51819 | 51838 | TAAAAATTATAGTGCCATCC | 51 | 3551 |
| 876966 | N/A | N/A | 54764 | 54783 | AATGCTACAGCAGAGCAGGC | 45 | 3552 |
| 876990 | N/A | N/A | 57307 | 57326 | AACTATTGGCAAACATAGTA | 76 | 3553 |

TABLE 47-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877014 | N/A | N/A | 59967 | 59986 | CATACAGACCTACAAACCAT | 69 | 3554 |
| 877038 | N/A | N/A | 62754 | 62773 | CATAATATGTACAAAATACA | 100 | 3555 |
| 877062 | N/A | N/A | 65304 | 65323 | AGTGATCCTGAATAATTAAC | 94 | 3556 |
| 877086 | N/A | N/A | 67065 | 67084 | TTTCTTAAGTGGGATACAAA | 66 | 3557 |
| 877110 | N/A | N/A | 70097 | 70116 | AATTCTTCCAGAGGAAGAAA | 123 | 3558 |
| 877134 | N/A | N/A | 72483 | 72502 | ATTGGAGAATAGGTTAGAAC | 64 | 3559 |
| 877158 | N/A | N/A | 73939 | 73958 | GATCTGTTTCCATTGCCTGC | 44 | 3560 |
| 877182 | N/A | N/A | 75408 | 75427 | TGTCCAGTCATTGAATGCCG | 30 | 3561 |
| 877206 | N/A | N/A | 78354 | 78373 | CTTTTAATAAAAGTGATGAT | 115 | 3562 |
| 877230 | N/A | N/A | 81470 | 81489 | ACAACACACTCAAGATCCAA | 68 | 3563 |
| 877237 | N/A | N/A | 82682 | 82701 | AACAGTTAAGAATAATTTGA | 122 | 3564 |
| 877261 | N/A | N/A | 85276 | 85295 | CACTATTTGAAAAAATGTCT | 81 | 3565 |
| 877285 | N/A | N/A | 88051 | 88070 | GACTGCCACTGTACTATTTG | 45 | 3566 |
| 877309 | N/A | N/A | 90454 | 90473 | GCAATCAAATGAGTTTTCAA | 66 | 3567 |
| 877333 | N/A | N/A | 92392 | 92411 | ATCAGTGGCCTATTAAAGAA | 98 | 3568 |
| 877357 | N/A | N/A | 94453 | 94472 | TGCAATGTTTCAATATGCTC | 34 | 3569 |
| 877381 | N/A | N/A | 96103 | 96122 | CAATACTCCAAAAACATGCA | 52 | 3570 |
| 877405 | N/A | N/A | 98870 | 98889 | TTAGTTATGCATAGACAAAT | 49 | 3571 |
| 877429 | N/A | N/A | 101479 | 101498 | ATATAATTATGAAATCTATT | 95 | 3572 |
| 877453 | N/A | N/A | 104214 | 104233 | GAGTATGGATTGTCATGTCT | 63 | 3573 |
| 877477 | N/A | N/A | 105993 | 106012 | ACAAAAGTCTTTTTGAGGC | 48 | 3574 |
| 877501 | N/A | N/A | 108768 | 108787 | TTACTACTATATATATATCA | 72 | 3575 |
| 877525 | N/A | N/A | 111286 | 111305 | CATGTCAGTTGGTTAGAACT | 62 | 3576 |
| 877549 | N/A | N/A | 113456 | 113475 | TATTACTACTTGCTATGAGG | 55 | 3577 |
| 877573 | N/A | N/A | 116029 | 116048 | ATGAGCTCTCTAGGCAGACA | 40 | 3578 |
| 877597 | N/A | N/A | 118217 | 118236 | AGTCTAATATTACACAGCAA | 41 | 3579 |
| 877621 | N/A | N/A | 120065 | 120084 | TTTTTCCAGGTGGAAATATA | 120 | 3580 |
| 877645 | N/A | N/A | 122402 | 122421 | ATTCAAAACTATTTAAATG | 118 | 3581 |
| 877669 | N/A | N/A | 125328 | 125347 | TAATGAGTACACAGTAATTC | 54 | 3582 |
| 877693 | N/A | N/A | 128602 | 128621 | TCAGATAATATGGTGGACAA | 53 | 3583 |
| 877717 | N/A | N/A | 132890 | 132909 | AGAGGCCCTACAAAGATTCA | 92 | 3584 |
| 877741 | N/A | N/A | 136288 | 136307 | TCAACAATATAGAGAGGATC | 113 | 3585 |
| 877765 | N/A | N/A | 140272 | 140291 | TGTATTTAATAGAAAATAGT | 114 | 3586 |
| 877789 | N/A | N/A | 141697 | 141716 | TGAAGTGCAAAGATAATTCT | 129 | 3587 |

TABLE 47-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877813 | N/A | N/A | 144037 | 144056 | CTGAGACAACCTATTGAGAG | 67 | 3588 |
| 877837 | N/A | N/A | 145342 | 145361 | CATATCACTTGTAATTTTGA | 43 | 3589 |

TABLE 48

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 18 | 222 |
| 876031 | 736 | 755 | 18635 | 18654 | ACGCACTTAACAATATCATA | 22 | 3590 |
| 876055 | 867 | 886 | 21698 | 21717 | TTCCACCACAATATTATAAC | 42 | 3591 |
| 876079 | 1298 | 1317 | N/A | N/A | CTATGAGCTGGGAAATGGCC | 62 | 3592 |
| 876103 | 1485 | 1504 | 35432 | 35451 | ACTTTCAGCCACTTCAGGAG | 38 | 3593 |
| 876127 | 1723 | 1742 | 41956 | 41975 | CATTCTTGAAACACTGTTTT | 39 | 3594 |
| 876151 | 2456 | 2475 | 62077 | 62096 | TGGCTGTCACCTTTCCCAAT | 33 | 3595 |
| 876175 | 3153 | 3172 | 73689 | 73708 | CTCCAGCTTTTCAAGATGCT | 33 | 3596 |
| 876199 | 3529 | 3548 | 77278 | 77297 | ATGAAATGTGGTTCTTACTA | 35 | 3597 |
| 876223 | 3854 | 3873 | 82199 | 82218 | TGCAGTTTCTCTACTCTAGA | 23 | 3598 |
| 876247 | 4317 | 4336 | 87221 | 87240 | ATGAGTACTATAGAATTCCT | 48 | 3599 |
| 876271 | 4753 | 4772 | 92176 | 92195 | TCCGGTCAATTACGGGAAAT | 36 | 3600 |
| 876295 | 5074 | 5093 | 98222 | 98241 | TCTGGAATTTTTCTAGGAGC | 26 | 150 |
| 876319 | 5454 | 5473 | 100443 | 100462 | AATGTGGTCCACAACTTGGC | 49 | 3601 |
| 876343 | 5792 | 5811 | 106483 | 106502 | GCTGCTCGGTAAACTGATCC | 46 | 3602 |
| 876367 | 6601 | 6620 | 129746 | 129765 | TGCTTGCATTCCTGCTGTTG | 43 | 3603 |
| 876391 | 7218 | 7237 | 141579 | 141598 | AACAGGGCTATTTTGCTTAG | 54 | 3604 |
| 876415 | 8131 | 8150 | 146300 | 146319 | TACATTACATGGGAAACTGT | 43 | 3605 |
| 876439 | 9021 | 9040 | 147190 | 147209 | AATACAGAAAATCTTTCATC | 120 | 3606 |
| 876463 | N/A | N/A | 4967 | 4986 | ATCAGGCACTTCTGAACACC | 51 | 3607 |
| 876487 | N/A | N/A | 7241 | 7260 | AGTGAGTATTAAAATGTCAG | 47 | 3608 |
| 876511 | N/A | N/A | 9214 | 9233 | TGCTCCCCAAGTAATGAAGC | 65 | 3609 |
| 876535 | N/A | N/A | 12417 | 12436 | GATTTTAATCCCTATGTTAT | 115 | 3610 |
| 876559 | N/A | N/A | 15046 | 15065 | ACTTCAATATATTCCAGTGT | 54 | 3611 |
| 876583 | N/A | N/A | 17338 | 17357 | TGCTATTCTGACTTTTGACA | 87 | 3612 |
| 876607 | N/A | N/A | 19605 | 19624 | GTTAATGGTCACTTACAAAA | 32 | 3613 |

TABLE 48-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876631 | N/A | N/A | 21986 | 22005 | GACACTCCTTTTAAAAGTCC | 33 | 3614 |
| 876655 | N/A | N/A | 25054 | 25073 | TTCAGCAACCACTCTCACTT | 60 | 3615 |
| 876679 | N/A | N/A | 27604 | 27623 | TTCATTGTGTAAAATAACTT | 95 | 3616 |
| 876703 | N/A | N/A | 29976 | 29995 | ATCACAGATGGCTCTGCAAT | 56 | 3617 |
| 876727 | N/A | N/A | 32024 | 32043 | ATAATAGACAATTTTACCAG | 33 | 3618 |
| 876751 | N/A | N/A | 33545 | 33564 | AGAACATTTTACACACTATC | 52 | 3619 |
| 876775 | N/A | N/A | 35950 | 35969 | CTATATAATCTTAGCATCTC | 86 | 3620 |
| 876799 | N/A | N/A | 38144 | 38163 | CATTGAGGTAAATGAGTACA | 83 | 3621 |
| 876823 | N/A | N/A | 39741 | 39760 | TTGATACCTAGAATGATACG | 71 | 3622 |
| 876847 | N/A | N/A | 42026 | 42045 | ATAGTATAAATACAGAAAAC | 84 | 3623 |
| 876871 | N/A | N/A | 45585 | 45604 | TTGGCTAACTGGAACCAGTT | 63 | 3624 |
| 876895 | N/A | N/A | 47882 | 47901 | GGAAGGAAAAAACGAATACC | 61 | 3625 |
| 876919 | N/A | N/A | 49713 | 49732 | ATCTTGAAATAGTAATGTAT | 67 | 3626 |
| 876943 | N/A | N/A | 52094 | 52113 | TGGGACTTGAATATAAATGT | 97 | 3627 |
| 876967 | N/A | N/A | 54851 | 54870 | TTGATAAGCAAAGTAGCCTT | 34 | 3628 |
| 876991 | N/A | N/A | 57309 | 57328 | TAAACTATTGGCAAACATAG | 79 | 3629 |
| 877015 | N/A | N/A | 60005 | 60024 | AGGTGATTTATGTTTTACTC | 56 | 3630 |
| 877039 | N/A | N/A | 62783 | 62802 | TCAGAAGATGGTAACTTACC | 85 | 3631 |
| 877063 | N/A | N/A | 65433 | 65452 | TAAGAGATACACCAGCAACT | 91 | 3632 |
| 877087 | N/A | N/A | 67067 | 67086 | GGTTTCTTAAGTGGGATACA | 45 | 3633 |
| 877111 | N/A | N/A | 70265 | 70284 | TACATAAGAAGAAATTTAAA | 105 | 3634 |
| 877135 | N/A | N/A | 72531 | 72550 | ATTAACACAAAACAACCCTC | 63 | 3635 |
| 877159 | N/A | N/A | 73941 | 73960 | CAGATCTGTTTCCATTGCCT | 23 | 3636 |
| 877183 | N/A | N/A | 75798 | 75817 | AGCAAACCCCTACTTACACA | 37 | 3637 |
| 877207 | N/A | N/A | 78361 | 78380 | TCTACAACTTTTAATAAAAG | 85 | 3638 |
| 877231 | N/A | N/A | 81545 | 81564 | AAAGATAAATTTACACATAT | 76 | 3639 |
| 877238 | N/A | N/A | 82750 | 82769 | AGAATTTTATCCTTATACT | 77 | 3640 |
| 877262 | N/A | N/A | 85277 | 85296 | CCACTATTTGAAAAAATGTC | 41 | 3641 |
| 877286 | N/A | N/A | 88222 | 88241 | ATTCACTCCTAAATAAAATA | 95 | 3642 |
| 877310 | N/A | N/A | 90580 | 90599 | ATGATCTCTAATAGATTAAA | 76 | 3643 |
| 877334 | N/A | N/A | 92439 | 92458 | ACATGATTGTCATGAACAC | 19 | 3644 |
| 877358 | N/A | N/A | 94604 | 94623 | TAAGTGCTCTGGGTCACACT | 53 | 3645 |
| 877382 | N/A | N/A | 96108 | 96127 | AGCACCAATACTCCAAAAAC | 67 | 3646 |
| 877406 | N/A | N/A | 98871 | 98890 | ATTAGTTATGCATAGACAAA | 83 | 3647 |
| 877430 | N/A | N/A | 101490 | 101509 | AATCTATGACAATATAATTA | 102 | 3648 |
| 877454 | N/A | N/A | 104219 | 104238 | ATATGGAGTATGGATTGTCA | 46 | 3649 |

TABLE 48-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877478 | N/A | N/A | 106035 | 106054 | ACTAGTTTTTATTCTACCTT | 90 | 3650 |
| 877502 | N/A | N/A | 108861 | 108880 | CTAACATATACTCTTGGAGC | 44 | 3651 |
| 877526 | N/A | N/A | 111304 | 111323 | AATCTTTTTTTAATGCCCA | 61 | 3652 |
| 877550 | N/A | N/A | 113493 | 113512 | TGATGGGTTCTAGAGCAGAA | 38 | 3653 |
| 877574 | N/A | N/A | 116095 | 116114 | GCTAACACTTCATGACACAC | 49 | 3654 |
| 877598 | N/A | N/A | 118289 | 118308 | AGCATCAAAAATTCTGTGCT | 51 | 3655 |
| 877622 | N/A | N/A | 120141 | 120160 | GTGGTCCAGTCCACCTTCAT | 61 | 3656 |
| 877646 | N/A | N/A | 122515 | 122534 | TTATGCTTCCCTTCTTAGAA | 63 | 3657 |
| 877670 | N/A | N/A | 125342 | 125361 | AAAACATTCCAGGATAATGA | 52 | 3658 |
| 877694 | N/A | N/A | 128625 | 128644 | TAAAACATGACAAGAGTTCT | 124 | 3659 |
| 877718 | N/A | N/A | 133009 | 133028 | TCTTAATTTGGTAGTTAGAT | 28 | 3660 |
| 877742 | N/A | N/A | 136525 | 136544 | GATGAAAGTAGGCCCCACTC | 70 | 3661 |
| 877766 | N/A | N/A | 140319 | 140338 | TGTCAGAGAGCCACTACGCT | 57 | 3662 |
| 877790 | N/A | N/A | 141746 | 141765 | TTCTCTATTCAGAGGCAGAA | 61 | 3663 |
| 877814 | N/A | N/A | 144077 | 144096 | TTCAACTAGAGAATGCAACA | 58 | 3664 |
| 877838 | N/A | N/A | 145702 | 145721 | AAAGATCCATCATAAAACAT | 111 | 3665 |

TABLE 49

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 28 | 222 |
| 876027 | 730 | 749 | 18629 | 18648 | TTAACAATATCATATAATCT | 6 | 3666 |
| 876051 | 838 | 857 | 21669 | 21688 | TGCCACTCATGAGGACTTCC | 39 | 3667 |
| 876075 | 1237 | 1256 | 29588 | 29607 | TAAGGAGATTATTTAGTGCC | 61 | 3668 |
| 876099 | 1481 | 1500 | 35428 | 35447 | TCAGCCACTTCAGGAGAATG | 53 | 3669 |
| 876123 | 1700 | 1719 | 41933 | 41952 | ACCATATTTAGCTTATGATG | 25 | 3670 |
| 876147 | 2450 | 2469 | 62071 | 62090 | TCACCTTTCCCAATGCTTAT | 77 | 3671 |
| 876171 | 2936 | 2955 | 72960 | 72979 | AAATCTTCATGATCAAAAAT | 85 | 3672 |
| 876195 | 3338 | 3357 | 76472 | 76491 | GTAGGATCTAAAACCACTGA | 22 | 3673 |
| 876219 | 3840 | 3859 | 82185 | 82204 | TCTAGACCATAAATATGCTT | 29 | 3674 |
| 876243 | 4312 | 4331 | 87216 | 87235 | TACTATAGAATTCCTCACGA | 58 | 3675 |
| 876267 | 4735 | 4754 | 92158 | 92177 | ATTCAATTGGCACATTTTTA | 49 | 3676 |

TABLE 49-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876291 | 5069 | 5088 | 98217 | 98236 | AATTTTTCTAGGAGCTTAAA | 107 | 3677 |
| 876315 | 5448 | 5467 | 100437 | 100456 | GTCCACAACTTGGCCCAAAA | 30 | 3678 |
| 876339 | 5694 | 5713 | 101332 | 101351 | CAGGTCAGCCAAAATCAAGT | 37 | 3679 |
| 876363 | 6466 | 6485 | 126582 | 126601 | TTTCTTGAGGATTTTCTTTC | 75 | 3680 |
| 876387 | 7046 | 7065 | 137450 | 137469 | ATTACATTTCTTTCCGTTGA | 53 | 3681 |
| 876411 | 7998 | 8017 | 146167 | 146186 | AAATTATCGGCCTTATAAAT | 96 | 3682 |
| 876435 | 8867 | 8886 | 147036 | 147055 | GGCCAAAGAATTTACCGAAA | 48 | 3683 |
| 876459 | N/A | N/A | 4386 | 4405 | TTTTTAAGGCCCCCTTTAAA | 95 | 3684 |
| 876483 | N/A | N/A | 7028 | 7047 | TTAGGTCTGTCACAAGCTCT | 50 | 3685 |
| 876507 | N/A | N/A | 8960 | 8979 | CAGTCTGTTTACAAGATGCC | 36 | 3686 |
| 876531 | N/A | N/A | 11871 | 11890 | TGAACAGTTGGTTTGTACAG | 67 | 3687 |
| 876555 | N/A | N/A | 14783 | 14802 | GGACTGATGAGGACAATTCA | 88 | 3688 |
| 876579 | N/A | N/A | 16929 | 16948 | AGGTGATCTATCCCATTCTG | 67 | 3689 |
| 876603 | N/A | N/A | 19458 | 19477 | GTGGCTAAATTTCAAAGCCT | 70 | 3690 |
| 876627 | N/A | N/A | 21316 | 21335 | TGGAAATGTAATGTATTGGT | 56 | 3691 |
| 876651 | N/A | N/A | 24654 | 24673 | GCAGTTGGTTTAGACTCCCC | 44 | 3692 |
| 876675 | N/A | N/A | 27306 | 27325 | AGGAAAAACTTTACCTGATA | 83 | 3693 |
| 876699 | N/A | N/A | 29666 | 29685 | ATTTTCTATCATATAAAATC | 93 | 3694 |
| 876723 | N/A | N/A | 31361 | 31380 | TAAAATTTTGTATATGTCAT | 146 | 3695 |
| 876747 | N/A | N/A | 33424 | 33443 | AGGTCTTACTCAATAGTCAC | 34 | 3696 |
| 876771 | N/A | N/A | 35347 | 35366 | CTGAAATTAACTGAGATTTT | 84 | 3697 |
| 876795 | N/A | N/A | 37878 | 37897 | TATAAAATTAATCTAAGTG | 85 | 3698 |
| 876819 | N/A | N/A | 39165 | 39184 | CTGATTGAATAGCCACCAGA | 110 | 3699 |
| 876843 | N/A | N/A | 41526 | 41545 | AAGCTCAGAGTTACTTGGAC | 52 | 3700 |
| 876867 | N/A | N/A | 45354 | 45373 | GACGCGGCAACTGTGGCAAT | 34 | 3701 |
| 876891 | N/A | N/A | 47370 | 47389 | ATGAATGATTACCATGTAAG | 87 | 3702 |
| 876915 | N/A | N/A | 49237 | 49256 | TCCAACATCATATGACTGAT | 62 | 3703 |
| 876939 | N/A | N/A | 51525 | 51544 | CAGTTTCTCACCCTGTGTCC | 50 | 3704 |
| 876963 | N/A | N/A | 54026 | 54045 | AGTTACAAAAAATATTTCCT | 79 | 3705 |
| 876987 | N/A | N/A | 56923 | 56942 | GAATTATATTTTGAAGGGAG | 66 | 3706 |
| 877011 | N/A | N/A | 59932 | 59951 | CCATTTTATATTCTCTATTA | 85 | 3707 |
| 877035 | N/A | N/A | 62618 | 62637 | TACATGTAAGCATATAAAAA | 116 | 3708 |
| 877059 | N/A | N/A | 64920 | 64939 | CCTGATGGAATTTCAAAGTT | 89 | 3709 |
| 877083 | N/A | N/A | 67061 | 67080 | TTAAGTGGGATACAAAAAGC | 65 | 3710 |
| 877107 | N/A | N/A | 69892 | 69911 | ATATTTCTCTATCAAATACA | 79 | 3711 |
| 877131 | N/A | N/A | 72432 | 72451 | GGCTCCCAATTTCCTCAACT | 25 | 3712 |

TABLE 49-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877155 | N/A | N/A | 73935 | 73954 | TGTTTCCATTGCCTGCCCTC | 62 | 3713 |
| 877179 | N/A | N/A | 75295 | 75314 | AATTGAAGGATTACCAAGTT | 67 | 3714 |
| 877203 | N/A | N/A | 78122 | 78141 | TGCATGTTTAGTTTAAGACT | 65 | 3715 |
| 877227 | N/A | N/A | 81187 | 81206 | GTTTTTACACAATGATCCAC | 57 | 3716 |
| 877234 | N/A | N/A | 82324 | 82343 | TCATGAAATTGGTATTTAGA | 73 | 3717 |
| 877258 | N/A | N/A | 84886 | 84905 | AGAGATTTTAGGCAGAAGAG | 68 | 3718 |
| 877282 | N/A | N/A | 87961 | 87980 | TGTATGCAGCCAATTACATG | 81 | 3719 |
| 877306 | N/A | N/A | 90436 | 90455 | AAACCATTATGCCAGAATGC | 54 | 3720 |
| 877330 | N/A | N/A | 91673 | 91692 | CTTTTGGATATTATTATATT | 76 | 3721 |
| 877354 | N/A | N/A | 94268 | 94287 | AATAATTTTAGGAACTCGGG | 85 | 3722 |
| 877378 | N/A | N/A | 95893 | 95912 | ACATTATCTTGACTTTATCA | 41 | 3723 |
| 877402 | N/A | N/A | 98345 | 98364 | TAGACTACAGTTAGTTTGAC | 49 | 3724 |
| 877426 | N/A | N/A | 101401 | 101420 | ATTACCTAGGAGAAACTCTG | 66 | 3725 |
| 877450 | N/A | N/A | 103499 | 103518 | TTCTGTAAATGAACATGGGA | 62 | 3726 |
| 877474 | N/A | N/A | 105725 | 105744 | CTCTCCTGTTCAGAAACAAA | 114 | 3727 |
| 877498 | N/A | N/A | 108194 | 108213 | GAGGGCGAGGAAACTAACTC | 66 | 3728 |
| 877522 | N/A | N/A | 111004 | 111023 | CACCATTCCCTTAGTTTGCC | 38 | 3729 |
| 877546 | N/A | N/A | 112841 | 112860 | AAGTGCATGAGTCCACATAT | 81 | 3730 |
| 877570 | N/A | N/A | 115680 | 115699 | TAGAGTCAAGGACCTGGTGG | 62 | 3731 |
| 877594 | N/A | N/A | 117784 | 117803 | CTTCTGTTTGAGTATATAAT | 83 | 3732 |
| 877618 | N/A | N/A | 119917 | 119936 | TTAGAGTTGCATATGGTTTA | 41 | 3733 |
| 877642 | N/A | N/A | 122346 | 122365 | ATTTGGAATCACAGGCTCTT | 66 | 3734 |
| 877666 | N/A | N/A | 125137 | 125156 | TTATGCACTAAACAAAAAAA | 106 | 3735 |
| 877690 | N/A | N/A | 128267 | 128286 | TGGGACCCCAAAGGACTGCA | 54 | 3736 |
| 877714 | N/A | N/A | 132254 | 132273 | TTTATTTAATTTTCAGCAAT | 78 | 3737 |
| 877738 | N/A | N/A | 135518 | 135537 | ATATCAAAGGGATTCCTATA | 113 | 3738 |
| 877762 | N/A | N/A | 139971 | 139990 | CCTCTCAGTCGGTGTGTACT | 102 | 3739 |
| 877786 | N/A | N/A | 141372 | 141391 | TAGACTATTGCAATTATTTC | 87 | 3740 |
| 877810 | N/A | N/A | 143858 | 143877 | TATTTCTTCACCATGTTCA | 97 | 3741 |
| 877834 | N/A | N/A | 145268 | 145287 | TACCATATGTAATATTTTCT | 57 | 3742 |

TABLE 50

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 24 | 222 |
| 803629 | N/A | N/A | 81591 | 81610 | AAGCCATAGTGTTTGAAGGA | 34 | 1791 |
| 876014 | 340 | 359 | 87848 | 87867 | CCTGCTGCACACTCGCGACT | 48 | 3743 |
| 876038 | 823 | 842 | 3731 | 3750 | CTTCCACATTATTGCAAGGA | 41 | 3744 |
| 876062 | 1022 | 1041 | 27997 | 28016 | GCTGCATTCTCTGGGTACTG | 28 | 3745 |
| 876086 | 1465 | 1484 | 35412 | 35431 | AATGTATATGCTTCTGCATT | 77 | 3746 |
| 876110 | 1494 | 1513 | 35441 | 35460 | TTTACAGCCACTTTCAGCCA | 63 | 3747 |
| 876134 | 2047 | 2066 | N/A | N/A | ATCCTTTAGTCTGTATTTCA | 83 | 3748 |
| 876158 | 2711 | 2730 | 65549 | 65568 | GACAGCACATCTTCAGAAAA | 64 | 3749 |
| 876182 | 3221 | 3240 | 76355 | 76374 | AAATGTGTCAAACTCTTCAG | 52 | 3750 |
| 876206 | 3747 | 3766 | 82092 | 82111 | TGCGGGACCTGGTAGGTACT | 57 | 3751 |
| 876230 | 3968 | 3987 | 83963 | 83982 | CCCATTTCATTGGGAAAGGA | 45 | 3752 |
| 876254 | 4520 | 4539 | 88621 | 88640 | AGTTCCTTGGTGATTTTACT | 45 | 3753 |
| 876278 | 4919 | 4938 | 93380 | 93399 | ATTTTACAAAGCCACTTGGG | 74 | 3754 |
| 876302 | 5195 | 5214 | 99201 | 99220 | GGCATTTCATATAGTCGGAT | 26 | 3755 |
| 876326 | 5644 | 5663 | 101282 | 101301 | GCCTTGGTTGATCTGGATTT | 32 | 3756 |
| 876350 | 6028 | 6047 | 113225 | 113244 | GTGCAATCCTGTGCTGTAGG | 42 | 3757 |
| 876374 | 6694 | 6713 | N/A | N/A | TACTATCAGCAACTTCCTCA | 100 | 3758 |
| 876398 | 7439 | 7458 | 143087 | 143106 | CGTATAAGTCGACGAGTTGA | 98 | 3759 |
| 876422 | 8442 | 8461 | 146611 | 146630 | TCAGGGTATCCACATTCAAA | 69 | 3760 |
| 876446 | N/A | N/A | 3734 | 3753 | TTACCTGCTGCACACTCGCG | 63 | 3761 |
| 876470 | N/A | N/A | 5242 | 5261 | TCCTTATTTTCCAGCATACT | 57 | 3762 |
| 876494 | N/A | N/A | 7823 | 7842 | TCTCTCTAAGAGAGAAGGTT | 64 | 3763 |
| 876518 | N/A | N/A | 10777 | 10796 | CTTCATGGTTTGAATTCAAA | 38 | 3764 |
| 876542 | N/A | N/A | 13175 | 13194 | AAATCATCAATTGTATACCT | 70 | 3765 |
| 876566 | N/A | N/A | 15815 | 15834 | CTCAATCAGTACTTCTAGCC | 79 | 3766 |
| 876590 | N/A | N/A | 17963 | 17982 | AGTTTATCTAGCTTGAGAAT | 67 | 3767 |
| 876614 | N/A | N/A | 20012 | 20031 | AAACCATGGCCTTTCTCTAT | 65 | 3768 |
| 876638 | N/A | N/A | 22763 | 22782 | CCAAAACATTATTATCCAGA | 58 | 3769 |
| 876662 | N/A | N/A | 26068 | 26087 | AGAAATTTGGGTTCTCAGCC | 64 | 3770 |
| 876686 | N/A | N/A | 28077 | 28096 | AAATGCCTCTGTAAGAATCC | 81 | 3771 |
| 876710 | N/A | N/A | 30722 | 30741 | AAGTGAGGAGAAGAGAATGG | 96 | 3772 |
| 876734 | N/A | N/A | 32675 | 32694 | TCTAAAGGTGCCCCAACAGA | 71 | 3773 |
| 876758 | N/A | N/A | 34015 | 34034 | ATCACATACACATTCTAAAA | 68 | 3774 |
| 876782 | N/A | N/A | 36424 | 36443 | ATAGATTAGTTAGACTGATG | 48 | 3775 |
| 876806 | N/A | N/A | 38547 | 38566 | TTCTGCTTGAAATGTCTTCC | 78 | 3776 |

TABLE 50-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876830 | N/A | N/A | 40757 | 40776 | TCTTTGTTCTATCACTTGAG | 72 | 3777 |
| 876854 | N/A | N/A | 42910 | 42929 | CCTTCTTCTCTTTTTCATAC | 42 | 3778 |
| 876878 | N/A | N/A | 46658 | 46677 | TAAAAATTTAGTCCTTCATC | 115 | 3779 |
| 876902 | N/A | N/A | 48098 | 48117 | AGGGTGCATAGTCTGTAGGT | 52 | 3780 |
| 876926 | N/A | N/A | 50310 | 50329 | CTGTTTGGCAGGCAAGGCCA | 114 | 3781 |
| 876950 | N/A | N/A | 52848 | 52867 | ATTCTAAATCCTGAATTCAA | 102 | 3782 |
| 876974 | N/A | N/A | 55881 | 55900 | AGGATGTTCATTTAACTATA | 53 | 3783 |
| 876998 | N/A | N/A | 57829 | 57848 | GAATATGGAAAGAGGAATAA | 94 | 3784 |
| 877022 | N/A | N/A | 61188 | 61207 | TCCATCAGTTACTGTGCTAA | 58 | 3785 |
| 877046 | N/A | N/A | 63238 | 63257 | GAAGAGAGAATTTAGAGCTA | 81 | 3786 |
| 877070 | N/A | N/A | 66210 | 66229 | AAAGCCCCTCACTCCATTTT | 60 | 3787 |
| 877094 | N/A | N/A | 67516 | 67535 | AAGTTAGTTGATTAAAAATT | 120 | 3788 |
| 877118 | N/A | N/A | 71000 | 71019 | ATAAATTTGGCTGGCAATAA | 76 | 3789 |
| 877142 | N/A | N/A | 72845 | 72864 | GTTAATGGTATTTATAATTA | 86 | 3790 |
| 877166 | N/A | N/A | 74324 | 74343 | ATTTTCAGAGAGCTATCCTA | 103 | 3791 |
| 877190 | N/A | N/A | 76592 | 76611 | CTTTCTTACCCTTCTAAAAT | 71 | 3792 |
| 877214 | N/A | N/A | 79053 | 79072 | CTGAGATGACACACTGACCA | 50 | 3793 |
| 877245 | N/A | N/A | 83601 | 83620 | CTCTTCAAGACATTGAAAGT | 81 | 3794 |
| 877269 | N/A | N/A | 86919 | 86938 | GAAATGAAGGGCTTTGGAAT | 76 | 3795 |
| 877293 | N/A | N/A | 89053 | 89072 | ATAAGAAGTTGAATCAGAAA | 99 | 3796 |
| 877317 | N/A | N/A | 91034 | 91053 | CTCTTAACCCAGAGAATTAG | 82 | 3797 |
| 877341 | N/A | N/A | 93061 | 93080 | ACAGAGCATATTTCACACAT | 42 | 3798 |
| 877365 | N/A | N/A | 95209 | 95228 | CCACAGAATCTTCAGGAATT | 45 | 3799 |
| 877389 | N/A | N/A | 96646 | 96665 | TTGGATAAATTATTCAACCT | 70 | 3800 |
| 877413 | N/A | N/A | 99821 | 99840 | TGATCATGCTAAACGCAAAA | 90 | 3801 |
| 877437 | N/A | N/A | 102050 | 102069 | GAATATTGAAACATGGTTAC | 48 | 3802 |
| 877461 | N/A | N/A | 104931 | 104950 | TCTTGGTATTCTCTCATTCT | 46 | 3803 |
| 877485 | N/A | N/A | 106787 | 106806 | TTACAACACACTATGTATCA | 86 | 3804 |
| 877509 | N/A | N/A | 109992 | 110011 | ATTAAACCAATATACCAAGG | 60 | 3805 |
| 877533 | N/A | N/A | 111782 | 111801 | GCAATTCAAAAAAGTCCGA | 58 | 3806 |
| 877557 | N/A | N/A | 114063 | 114082 | TGAGAGAAATTGTTAGAAGC | 85 | 3807 |
| 877581 | N/A | N/A | 116850 | 116869 | TTTATAGAACACAGACTCTT | 88 | 3808 |
| 877605 | N/A | N/A | 119162 | 119181 | AGGGAGGTAAGATTCCACAG | 62 | 3809 |
| 877629 | N/A | N/A | 121067 | 121086 | CATATGTCAGAGGGTCCTAA | 63 | 3810 |
| 877653 | N/A | N/A | 123315 | 123334 | TTTGCTAAAATTATCTGTGC | 65 | 3811 |
| 877677 | N/A | N/A | 126752 | 126771 | GATGGTGAAAATTATAGGAG | 50 | 3812 |

TABLE 50-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877701 | N/A | N/A | 129290 | 129309 | AAAAACCCTTGGGCCAACAA | 71 | 3813 |
| 877725 | N/A | N/A | 133380 | 133399 | CCCTGCTGTGATAGGCTTGA | 51 | 3814 |
| 877749 | N/A | N/A | 138071 | 138090 | TTGAAAGAGGTTTATATTAA | 95 | 3815 |
| 877773 | N/A | N/A | 140699 | 140718 | GGTGTCACTGTCATATTATA | 60 | 3816 |
| 877797 | N/A | N/A | 142490 | 142509 | ATAGTCTAATTCATGACAAA | 102 | 3817 |
| 877821 | N/A | N/A | 144612 | 144631 | CTATGTAGGCCCTAGGCTAG | 73 | 3818 |

Example 5: Effect of 5-10-5 MOE Gapmers with Phosphorothioate Internucleoside Linkages on Human LRRK2 RNA Expression In Vitro, Multiple Doses Modified oligonucleotides selected from Example 1 above were tested at various doses in SH-SY5Y cells. Cells were plated at a density of 20,000 cells per well and transfected using electroporation with 1.125 µM, 2.250 µM, 4.500 µM, 9.000 µM, and 18.000 µM concentrations of modified oligonucleotide, as specified in the tables below. After a treatment period of approximately 24 hours, total RNA was isolated from the cells and LRRK2 RNA levels were measured by quantitative real-time PCR. Human LRRK2 primer probe set RTS3133_MGB (described herein in Example 1) was used to measure RNA levels. LRRK2 RNA levels were adjusted according to total RNA content, as measured by RIBOGREEN®. Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response—variable slope (4 parameters)" formula using Prism6 software.

TABLE 51

Dose-dependent reduction of human LRRK2 RNA expression in SH-SY5Y cells

| | LRRK2 expression (% control) | | | | | |
|---|---|---|---|---|---|---|
| Compound Number | 1.125 µM | 2.250 µM | 4.500 µM | 9.000 µM | 18.000 µM | IC$_{50}$ (µM) |
| 438387 | 81 | 43 | 30 | 18 | 14 | 2 |
| 438429 | 119 | 109 | 116 | 89 | 81 | 31 |
| 438432 | 110 | 78 | 64 | 42 | 15 | 7 |
| 438543 | 94 | 85 | 69 | 44 | 42 | 10 |
| 438565 | 92 | 80 | 80 | 66 | 53 | 22 |
| 438569 | 94 | 79 | 65 | 51 | 47 | 12 |
| 438586 | 98 | 85 | 52 | 38 | 27 | 6 |
| 438587 | 91 | 80 | 58 | 43 | 32 | 7 |
| 438595 | 86 | 66 | 41 | 35 | 25 | 4 |
| 438597 | 45 | 39 | 37 | 32 | 18 | n/a* |
| 438602 | 59 | 73 | 50 | 30 | 33 | 4 |
| 438622 | 109 | 115 | 100 | 92 | 85 | 40 |
| 438625 | 110 | 108 | 96 | 94 | 81 | 36 |
| 422428 | 75 | 57 | 35 | 27 | 20 | 3 |
| 422433 | 75 | 56 | 32 | 18 | 15 | 3 |
| 422450 | 81 | 97 | 87 | 71 | 66 | 51 |
| 422451 | 74 | 52 | 40 | 29 | 26 | 3 |
| 422461 | 89 | 65 | 44 | 30 | 25 | 4 |
| 438538 | 72 | 54 | 33 | 20 | 16 | 3 |
| 438544 | 65 | 39 | 28 | 18 | 12 | 2 |
| 438545 | 90 | 60 | 37 | 15 | 13 | 3 |
| 438548 | 89 | 65 | 38 | 20 | 16 | 4 |
| 438550 | 95 | 78 | 59 | 34 | 15 | 6 |
| 438560 | 56 | 41 | 30 | 22 | 23 | 1 |
| 438588 | 65 | 57 | 49 | 26 | 17 | 3 |
| 438652 | 109 | 94 | 74 | 54 | 53 | 15 |

*IC$_{50}$ value could not be calculated

Example 6: Effect of 5-10-5 MOE Gapmers with Mixed Internucleoside Linkages on Human LRRK2 RNA Expression In Vitro, Multiple Doses Modified oligonucleotides selected from Examples 2 and 3 above were tested at various doses in SH-SY5Y cells. Cells were plated at a density of 20,000 cells per well and transfected using electroporation with 0.333 µM, 1.000 µM, 3.000 µM, and 9.000 µM concentrations of modified oligonucleotide, as specified in the tables below. After a treatment period of approximately 24 hours, total RNA was isolated from the cells and LRRK2 RNA levels were measured by quantitative real-time PCR. Human LRRK2 primer probe set RTS3132 (described hereinabove in Example 2) was used to measure RNA levels. LRRK2 RNA levels were adjusted according to total RNA content, as measured by RIBOGREEN®. Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response—variable slope (4 parameters)" formula using Prism6 software.

TABLE 52

Dose-dependent reduction of human LRRK2 expression in SH-SY5Y cells

| Compound Number | LRRK2 expression (% control) | | | | $IC_{50}$ (μM) |
|---|---|---|---|---|---|
| | 0.333 μM | 1.000 μM | 3.000 μM | 9.000 μM | |
| 693423 | 62 | 46 | 45 | 13 | 0.9 |
| 693428 | 58 | 45 | 34 | 13 | 0.7 |
| 693430 | 68 | 28 | 32 | 26 | 0.6 |
| 725607 | 66 | 42 | 30 | 21 | 0.8 |
| 725608 | 54 | 44 | 36 | 40 | 0.4 |
| 780148 | 80 | 67 | 51 | 19 | 2.2 |
| 780162 | 56 | 35 | 29 | 19 | 0.4 |
| 780164 | 43 | 24 | 21 | 24 | 0.07 |
| 780166 | 60 | 51 | 26 | 18 | 0.8 |
| 780189 | 60 | 37 | 22 | 31 | 0.5 |
| 780202 | 70 | 42 | 36 | 20 | 0.9 |
| 780205 | 68 | 44 | 32 | 25 | 0.9 |
| 780210 | 62 | 56 | 31 | 25 | 1.0 |
| 780219 | 75 | 52 | 24 | 31 | 1.2 |
| 780236 | 42 | 34 | 29 | 19 | 0.1 |
| 780241 | 67 | 47 | 18 | 5 | 0.8 |
| 780243 | 37 | 41 | 26 | 25 | n/a* |
| 780254 | 68 | 37 | 35 | 19 | 0.8 |
| 780284 | 66 | 44 | 26 | 19 | 0.8 |

*$IC_{50}$ value cannot be calculated

TABLE 53

Dose-dependent reduction of human LRRK2 expression in SH-SY5Y cells

| Compound Number | LRRK2 expression (% control) | | | | $IC_{50}$ (μM) |
|---|---|---|---|---|---|
| | 0.333 μM | 1.000 μM | 3.000 μM | 9.000 μM | |
| 780254 | 61 | 45 | 23 | 17 | 0.7 |
| 780321 | 66 | 59 | 46 | 25 | 1.6 |
| 780347 | 55 | 47 | 43 | 47 | 0.8 |
| 780430 | 82 | 70 | 55 | 33 | 3.5 |
| 780442 | 80 | 81 | 43 | 31 | 3.0 |
| 780455 | 92 | 61 | 47 | 21 | 2.2 |
| 780461 | 74 | 90 | 72 | 40 | 7.3 |
| 780499 | 74 | 67 | 36 | 36 | 2.2 |
| 780535 | 86 | 71 | 75 | 63 | >60 |
| 780549 | 56 | 31 | 19 | 2 | 0.4 |
| 780551 | 93 | 65 | 26 | 35 | 1.9 |
| 780602 | 52 | 41 | 27 | 17 | 0.4 |
| 780624 | 71 | 52 | 37 | 27 | 1.3 |
| 780649 | 67 | 40 | 29 | 12 | 0.7 |
| 780670 | 85 | 71 | 55 | 31 | 3.4 |
| 780685 | 73 | 43 | 29 | 15 | 0.9 |
| 780700 | 96 | 61 | 36 | 24 | 2.0 |
| 780704 | 84 | 86 | 45 | 37 | 3.8 |
| 780706 | 94 | 72 | 66 | 42 | 6.1 |

Example 7: Effect of 5-10-5 MOE Gapmers with Mixed Internucleoside Linkages on Human LRRK2 RNA Expression In Vitro, Multiple Doses Modified oligonucleotides selected from Example 4 above were tested at various doses in SH-SY5Y cells. Cells were plated at a density of 20,000 cells per well and transfected using electroporation with 0.296, 0.888, 2.666, and 8.000 μM concentrations of modified oligonucleotide, as specified in the tables below. After a treatment period of approximately 24 hours, total RNA was isolated from the cells and LRRK2 RNA levels were measured by quantitative real-time PCR. Human LRRK2 primer probe set RTS3132 (described herein in Example 2) was used to measure RNA levels. LRRK2 RNA levels were adjusted according to total RNA content, as measured by RIBOGREEN®. Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response—variable slope (4 parameters)" formula using Prism6 software.

TABLE 54

Dose-dependent reduction of human LRRK2 expression in SH-SY5Y cells

| Compound Number | LRRK2 expression (% control) | | | | $IC_{50}$ (μM) |
|---|---|---|---|---|---|
| | 0.296 μM | 0.888 μM | 2.666 μM | 8.000 μM | |
| 780254 | 58 | 36 | 30 | 15 | 0.5 |
| 802655 | 103 | 90 | 87 | 20 | 5.0 |
| 802678 | 51 | 68 | 25 | 5 | 0.7 |
| 802685 | 110 | 82 | 43 | 13 | 2.3 |
| 802686 | 147 | 115 | 70 | 29 | 4.8 |
| 802688 | 87 | 67 | 40 | 15 | 1.7 |
| 802689 | 85 | 69 | 52 | 6 | 2.0 |
| 802700 | 163 | 84 | 29 | 29 | 2.0 |
| 802731 | 155 | 89 | 43 | 40 | 3.7 |
| 802746 | 120 | 78 | 65 | 18 | 3.5 |
| 802748 | 116 | 82 | 36 | 12 | 2.1 |
| 802758 | 119 | 71 | 31 | 5 | 1.7 |
| 802769 | 87 | 81 | 39 | 38 | 2.9 |
| 802778 | 97 | 53 | 56 | 30 | 2.6 |
| 802780 | 92 | 53 | 34 | 22 | 1.4 |
| 802784 | 84 | 82 | 42 | 26 | 2.5 |
| 802832 | 116 | 62 | 94 | 31 | 6.0 |
| 802888 | 58 | 54 | 26 | 10 | 0.7 |
| 802915 | 80 | 50 | 28 | 10 | 1.0 |

TABLE 55

Dose-dependent reduction of human LRRK2 expression in SH-SY5Y cells

| Compound Number | LRRK2 expression (% control) | | | | $IC_{50}$ (μM) |
|---|---|---|---|---|---|
| | 0.296 μM | 0.888 μM | 2.666 μM | 8.000 μM | |
| 780254 | 76 | 56 | 26 | 12 | 1.0 |
| 802845 | 127 | 100 | 43 | 13 | 1.0 |
| 802911 | 77 | 44 | 27 | 11 | 0.8 |
| 802924 | 184 | 159 | 59 | 18 | n/a* |
| 802934 | 158 | 108 | 93 | 47 | 7.6 |
| 802949 | 113 | 69 | 33 | No signal | 1.7 |
| 802962 | 128 | 150 | 93 | 27 | 6.1 |
| 802966 | 171 | 130 | 17 | 31 | n/a* |
| 802974 | 120 | 71 | 36 | 13 | 1.9 |
| 803000 | 106 | 158 | 57 | 36 | 4.9 |
| 803021 | 80 | 112 | 75 | 70 | 22.1 |
| 803045 | 87 | 68 | 54 | 32 | 3.0 |
| 803046 | 70 | 69 | 28 | 14 | 1.2 |
| 803054 | 104 | 114 | 116 | 45 | n/a* |
| 803064 | 60 | 80 | 62 | 26 | 3.1 |
| 803065 | 101 | 89 | 27 | 55 | 4.0 |
| 803075 | 94 | 56 | 53 | 10 | 1.8 |
| 803112 | 90 | 37 | 27 | 11 | 0.9 |
| 803122 | 74 | 63 | 26 | 27 | 1.3 |

*$IC_{50}$ value cannot be calculated

TABLE 56

Dose-dependent reduction of human LRRK2 expression in SH-SY5Y cells

| Compound Number | LRRK2 expression (% control) | | | | $IC_{50}$ (μM) |
|---|---|---|---|---|---|
| | 0.296 μM | 0.888 μM | 2.666 μM | 8.000 μM | |
| 780254 | 57 | 43 | 30 | 10 | 0.5 |
| 803102 | 76 | 76 | 46 | 28 | 2.4 |
| 803123 | 103 | 110 | 60 | 30 | 4.2 |
| 803172 | 104 | 87 | 82 | 46 | 7.3 |
| 803177 | 138 | 98 | 72 | 41 | 5.9 |
| 803181 | 142 | 84 | 86 | 50 | 8.0 |
| 803272 | 105 | 94 | 68 | 47 | 6.6 |
| 803285 | 87 | 80 | 56 | 38 | 4.1 |
| 803359 | 102 | 81 | 105 | 69 | n/a* |
| 803386 | 81 | 65 | 28 | 24 | 1.4 |
| 803436 | 116 | 97 | 59 | 81 | n/a* |
| 803470 | 60 | 61 | 25 | 44 | 1.1 |
| 803503 | 71 | 50 | 61 | 50 | 8.4 |
| 803517 | 75 | 48 | 58 | 22 | 1.7 |
| 803519 | 80 | 59 | 43 | 52 | 3.9 |
| 803571 | 65 | 57 | 36 | 26 | 1.1 |
| 803595 | 66 | 62 | 34 | 25 | 1.2 |
| 803603 | 86 | 65 | 59 | 29 | 3.0 |
| 803604 | 50 | 32 | 52 | 22 | 0.2 |

*$IC_{50}$ value cannot be calculated

TABLE 57

Dose-dependent reduction of human LRRK2 expression in SH-SY5Y cells

| Compound Number | LRRK2 expression (% control) | | | | $IC_{50}$ (μM) |
|---|---|---|---|---|---|
| | 0.296 μM | 0.888 μM | 2.666 μM | 8.000 μM | |
| 780254 | 54 | 45 | 18 | 22 | 0.4 |
| 780620 | 120 | 87 | 77 | 37 | 5.7 |
| 780624 | 133 | 66 | 38 | 62 | 5.5 |
| 803541 | 110 | 86 | 40 | 16 | 2.3 |
| 803628 | 140 | 77 | 57 | 15 | 3.0 |
| 803629 | 78 | 31 | 40 | 15 | 0.8 |
| 803640 | 116 | 125 | 81 | 39 | 6.4 |
| 803645 | 123 | 117 | 59 | 33 | 4.5 |
| 803665 | 154 | 121 | 68 | 48 | 6.8 |
| 803680 | 87 | 71 | 39 | 27 | 2.1 |
| 803682 | 94 | 64 | 31 | 17 | 1.5 |
| 803686 | 79 | 69 | 54 | 21 | 2.3 |
| 803744 | 85 | 50 | 29 | 20 | 1.1 |
| 803745 | 91 | 75 | 55 | 24 | 2.9 |
| 803769 | 60 | 79 | 48 | 19 | 1.9 |
| 803770 | 43 | 38 | 25 | 5 | 0.2 |
| 803771 | 49 | 47 | 20 | 11 | 0.4 |
| 803773 | 73 | 54 | 28 | 28 | 1.1 |
| 803782 | 75 | 61 | 22 | 16 | 1.1 |

Example 8: Effect of 5-10-5 MOE Gapmers with Mixed Internucleoside Linkages on Human LRRK2 RNA Expression In Vitro, Multiple Doses Modified oligonucleotides selected from Example 4 above were tested at various doses in SH-SY5Y cells. Cells were plated at a density of 20,000 cells per well and transfected using electroporation with 0.444, 1.333, 4.000, and 12.000 μM concentrations of modified oligonucleotide, as specified in the tables below. After a treatment period of approximately 24 hours, total RNA was isolated from the cells and LRRK2 RNA levels were measured by quantitative real-time PCR. Human LRRK2 primer probe set RTS3132 (described herein in Example 2) was used to measure RNA levels. LRRK2 RNA levels were adjusted according to total RNA content, as measured by RIBOGREEN®. Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response—variable slope (4 parameters)" formula using Prism6 software.

TABLE 58

Dose-dependent reduction of human LRRK2 expression in SH-SY5Y cells

| Compound Number | LRRK2 expression (% control) | | | | $IC_{50}$ (μM) |
|---|---|---|---|---|---|
| | 0.444 μM | 1.333 μM | 4.000 μM | 12.000 μM | |
| 780241 | 57 | 29 | 9 | 3 | 0.6 |
| 876032 | 80 | 56 | 25 | 12 | 1.6 |
| 876033 | 65 | 45 | 45 | 8 | 1.3 |
| 876035 | 65 | 59 | 35 | 17 | 1.6 |
| 876200 | 105 | 49 | 29 | 17 | 1.9 |
| 876201 | 83 | 84 | 45 | 22 | 3.8 |
| 876204 | 58 | 38 | 22 | 14 | 0.7 |
| 876224 | 74 | 48 | 41 | 15 | 1.6 |
| 876274 | 70 | 48 | 26 | 16 | 1.2 |
| 876298 | 60 | 47 | 42 | 28 | 1.2 |
| 876611 | 71 | 52 | 27 | 16 | 1.4 |
| 876683 | 79 | 58 | 23 | 27 | 1.8 |
| 876706 | 80 | 57 | 43 | 17 | 2.2 |
| 876850 | 89 | 64 | 37 | 16 | 2.4 |
| 876899 | 42 | 29 | 18 | 9 | 0.3 |
| 877113 | 53 | 44 | 34 | 10 | 0.7 |
| 877160 | 88 | 57 | 29 | 14 | 1.9 |
| 877239 | 115 | 93 | 59 | 31 | 6.1 |
| 877722 | 72 | 43 | 38 | 28 | 1.5 |

TABLE 59

Dose-dependent reduction of human LRRK2 expression in SH-SY5Y cells

| Compound Number | LRRK2 expression (% control) | | | | $IC_{50}$ (μM) |
|---|---|---|---|---|---|
| | 0.444 μM | 1.333 μM | 4.000 μM | 12.000 μM | |
| 780241 | 54 | 37 | 41 | 19 | n/a* |
| 803629 | 90 | 60 | 31 | 31 | 2.5 |
| 876062 | 62 | 38 | 16 | 7 | 0.8 |
| 876084 | 114 | 89 | 42 | 18 | 3.7 |
| 876109 | 84 | 58 | 59 | 40 | 5.6 |
| 876156 | 80 | 68 | 28 | 31 | 2.5 |
| 876180 | 79 | 53 | 41 | 15 | 1.9 |
| 876181 | 73 | 51 | 31 | 33 | 1.7 |
| 876276 | 93 | 51 | 19 | 11 | 1.5 |
| 876301 | 55 | 41 | 32 | 7 | 0.7 |
| 876302 | 47 | 25 | 21 | 7 | 0.3 |
| 876326 | 66 | 50 | 35 | 12 | 1.3 |
| 876900 | 63 | 42 | 21 | 13 | 0.9 |
| 876901 | 63 | 56 | 36 | 29 | 1.6 |
| 877068 | 66 | 42 | 17 | 5 | 0.9 |
| 877292 | 53 | 34 | 16 | 28 | 0.4 |
| 877364 | 71 | 53 | 28 | 31 | 1.6 |
| 877388 | 57 | 56 | 34 | 37 | 1.3 |
| 877748 | 71 | 58 | 40 | 24 | 2.0 |

*$IC_{50}$ value cannot be calculated

TABLE 60

Dose-dependent reduction of human LRRK2 expression in SH-SY5Y cells

| Compound Number | LRRK2 expression (% control) | | | | IC$_{50}$ (μM) |
|---|---|---|---|---|---|
| | 0.444 μM | 1.333 μM | 4.000 μM | 12.000 μM | |
| 780241 | 87 | 35 | 22 | 14 | 1.2 |
| 876038 | 68 | 39 | 40 | 32 | 1.3 |
| 876041 | 78 | 60 | 31 | 23 | 2.0 |
| 876042 | 52 | 34 | 25 | 12 | 0.5 |
| 876088 | 77 | 61 | 56 | 20 | 3.1 |
| 876089 | 80 | 76 | 48 | 15 | 3.2 |
| 876090 | 73 | 53 | 38 | 22 | 1.8 |
| 876185 | 55 | 52 | 32 | 15 | 0.9 |
| 876186 | 52 | 33 | 23 | 11 | 0.5 |
| 876282 | 53 | 35 | 25 | 11 | 0.5 |
| 876328 | 79 | 60 | 25 | 15 | 1.7 |
| 876401 | 83 | 60 | 52 | 42 | 5.1 |
| 876518 | 75 | 75 | 39 | 22 | 2.8 |
| 876713 | 61 | 59 | 50 | 19 | 1.9 |
| 876905 | 75 | 58 | 42 | 25 | 2.3 |
| 877098 | 82 | 54 | 34 | 24 | 2.0 |
| 877170 | 71 | 60 | 35 | 24 | 1.9 |
| 877392 | 68 | 48 | 31 | 23 | 1.3 |
| 877753 | 67 | 55 | 26 | 22 | 1.4 |

TABLE 61

Dose-dependent reduction of human LRRK2 expression in SH-SY5Y cells

| Compound Number | LRRK2 expression (% control) | | | | IC$_{50}$ (μM) |
|---|---|---|---|---|---|
| | 0.444 μM | 1.333 μM | 4.000 μM | 12.000 μM | |
| 780241 | 70 | 44 | 39 | 18 | 1.4 |
| 876019 | 67 | 45 | 28 | 11 | 1.1 |
| 876020 | 67 | 55 | 49 | 25 | 2.2 |
| 876066 | 60 | 62 | 36 | 19 | 1.5 |
| 876139 | 78 | 37 | 39 | 10 | 1.3 |
| 876140 | 80 | 47 | 36 | 14 | 1.6 |
| 876255 | 72 | 39 | 33 | 27 | 1.2 |
| 876260 | 70 | 46 | 22 | 29 | 1.2 |
| 876261 | 33 | 25 | 18 | 4 | n/a* |
| 876283 | 75 | 60 | 29 | 13 | 1.7 |
| 876284 | 48 | 35 | 35 | 18 | n/a* |
| 876303 | 48 | 21 | 32 | 2 | 0.3 |
| 876499 | 66 | 72 | 42 | 26 | 2.7 |
| 876735 | 67 | 43 | 28 | 7 | 1.0 |
| 876927 | 63 | 42 | 37 | 41 | 1.2 |
| 877119 | 61 | 31 | 35 | 4 | 0.7 |
| 877246 | 78 | 58 | 43 | 34 | 2.9 |
| 877370 | 69 | 58 | 46 | 40 | 3.3 |
| 877635 | 77 | 82 | 46 | 24 | 3.7 |

*IC$_{50}$ value cannot be calculated

TABLE 62

Dose-dependent reduction of human LRRK2 expression in SH-SY5Y cells

| Compound Number | LRRK2 expression (% control) | | | | IC$_{50}$ (μM) |
|---|---|---|---|---|---|
| | 0.444 μM | 1.333 μM | 4.000 μM | 12.000 μM | |
| 780241 | 62 | 42 | 16 | 23 | 0.8 |
| 780624 | 70 | 37 | 21 | 6 | 0.9 |
| 803640 | 80 | 34 | 53 | 43 | 3.0 |
| 876141 | 66 | 50 | 30 | 17 | 1.2 |
| 876143 | 70 | 55 | 38 | 29 | 1.9 |
| 876165 | 110 | 74 | 54 | 18 | 4.1 |
| 876166 | 64 | 53 | 34 | 27 | 1.4 |
| 876189 | 62 | 33 | 24 | 22 | 0.7 |
| 876190 | 44 | 27 | 34 | 10 | 0.2 |
| 876213 | 71 | 50 | 37 | 12 | 1.5 |
| 876237 | 52 | 41 | 20 | 15 | 0.6 |
| 876262 | 59 | 37 | 21 | 13 | 0.7 |
| 876263 | 61 | 36 | 36 | 23 | 0.8 |
| 876285 | 68 | 62 | 31 | 23 | 1.8 |
| 876286 | 69 | 67 | 33 | 21 | 2.0 |
| 876645 | 94 | 59 | 47 | 17 | 2.8 |
| 876766 | 67 | 37 | 26 | 13 | 0.9 |
| 876790 | 58 | 41 | 33 | 13 | 0.8 |
| 877222 | 68 | 48 | 32 | 20 | 1.3 |

TABLE 63

Dose-dependent reduction of human LRRK2 expression in SH-SY5Y cells

| Compound Number | LRRK2 expression (% control) | | | | IC$_{50}$ (μM) |
|---|---|---|---|---|---|
| | 0.444 μM | 1.333 μM | 4.000 μM | 12.000 μM | |
| 780241 | 71 | 54 | 41 | 27 | 2.0 |
| 876072 | 73 | 57 | 40 | 29 | 2.2 |
| 876073 | 72 | 52 | 24 | 25 | 1.4 |
| 876095 | 101 | 80 | 61 | 31 | 5.8 |
| 876097 | 55 | 44 | 42 | 24 | n/a* |
| 876168 | 64 | 45 | 21 | 9 | 0.9 |
| 876215 | 88 | 62 | 37 | 13 | 2.3 |
| 876288 | 75 | 62 | 28 | 6 | 1.7 |
| 876289 | 73 | 65 | 41 | 20 | 2.3 |
| 876335 | 77 | 75 | 43 | 25 | 3.2 |
| 876527 | 90 | 73 | 41 | 21 | 3.1 |
| 876769 | 78 | 67 | 41 | 31 | 1.5 |
| 877176 | 75 | 55 | 41 | 7 | 1.8 |
| 877303 | 61 | 45 | 23 | 19 | 0.8 |
| 877328 | 64 | 38 | 27 | 12 | 0.9 |
| 877375 | 82 | 68 | 47 | 28 | 3.5 |
| 877615 | 58 | 61 | 33 | 21 | 1.4 |
| 877616 | 75 | 50 | 25 | 19 | 1.4 |
| 877806 | 83 | 76 | 50 | 26 | 4.0 |

*IC$_{50}$ value can't be calculated

TABLE 64

Dose-dependent reduction of human LRRK2 expression in SH-SY5Y cells

| Compound Number | LRRK2 expression (% control) | | | | IC$_{50}$ (μM) |
|---|---|---|---|---|---|
| | 0.444 μM | 1.333 μM | 4.000 μM | 12.000 μM | |
| 780241 | 66 | 53 | 29 | 24 | 1.4 |
| 876050 | 83 | 58 | 52 | 17 | 2.8 |
| 876052 | 72 | 48 | 53 | 17 | 2.0 |
| 876053 | 75 | 47 | 36 | 20 | 1.6 |
| 876098 | 95 | 59 | 38 | 16 | 2.4 |
| 876149 | 71 | 52 | 28 | 20 | 1.4 |
| 876218 | 79 | 61 | 44 | 17 | 2.4 |
| 876220 | 68 | 43 | 39 | 18 | 1.3 |
| 876221 | 48 | 29 | 16 | 9 | 0.4 |
| 876293 | 72 | 54 | 21 | 17 | 1.3 |
| 876337 | 85 | 90 | 59 | 19 | 4.9 |
| 876362 | 86 | 73 | 54 | 26 | 4.2 |

TABLE 64-continued

Dose-dependent reduction of human LRRK2 expression in SH-SY5Y cells

| Compound Number | LRRK2 expression (% control) | | | | IC$_{50}$ (μM) |
|---|---|---|---|---|---|
| | 0.444 μM | 1.333 μM | 4.000 μM | 12.000 μM | |
| 876385 | 81 | 62 | 36 | 20 | 2.3 |
| 876604 | 48 | 27 | 23 | 16 | 0.3 |
| 876725 | 66 | 50 | 39 | 35 | 1.7 |
| 876890 | 76 | 57 | 37 | 21 | 2.0 |
| 877156 | 80 | 58 | 44 | 28 | 2.7 |
| 877355 | 71 | 46 | 42 | 14 | 1.5 |
| 877356 | 49 | 41 | 24 | 29 | 0.3 |

TABLE 65

Dose-dependent reduction of human LRRK2 expression in SH-SY5Y cells

| Compound Number | LRRK2 expression (% control) | | | | IC$_{50}$ (μM) |
|---|---|---|---|---|---|
| | 0.444 μM | 1.333 μM | 4.000 μM | 12.000 μM | |
| 780241 | 75 | 62 | 42 | 15 | 2.2 |
| 876027 | 87 | 76 | 74 | 54 | n/a* |
| 876030 | 75 | 60 | 44 | 18 | 2.3 |
| 876031 | 69 | 44 | 43 | 13 | 1.4 |
| 876123 | 68 | 48 | 28 | 27 | 1.3 |
| 876150 | 82 | 55 | 48 | 27 | 2.8 |
| 876195 | 77 | 51 | 31 | 45 | 2.4 |
| 876219 | 77 | 65 | 46 | 24 | 2.9 |
| 876222 | 102 | 68 | 54 | 21 | 3.9 |
| 876223 | 74 | 58 | 41 | 16 | 2.0 |
| 876294 | 44 | 25 | 16 | 10 | 0.3 |
| 876295 | 71 | 48 | 51 | 36 | 2.7 |
| 876315 | 75 | 58 | 46 | 41 | 3.7 |
| 877131 | 83 | 67 | 43 | 23 | 2.9 |
| 877159 | 68 | 59 | 41 | 24 | 2.0 |
| 877182 | 104 | 88 | 70 | 19 | 5.9 |
| 877334 | 93 | 87 | 51 | 22 | 4.4 |
| 877357 | 97 | 84 | 51 | 25 | 4.5 |
| 877718 | 73 | 57 | 51 | 32 | 3.0 |

*IC$_{50}$ value cannot be calculated

TABLE 66

Dose-dependent reduction of human LRRK2 expression in SH-SY5Y cells

| Compound Number | LRRK2 expression (% control) | | | | IC$_{50}$ (μM) |
|---|---|---|---|---|---|
| | 0.444 μM | 1.333 μM | 4.000 μM | 12.000 μM | |
| 780241 | 63 | 36 | 24 | 23 | 0.8 |
| 803627 | 76 | 52 | 30 | 10 | 1.4 |
| 876008 | 59 | 56 | 33 | 31 | 1.3 |
| 876011 | 90 | 66 | 45 | 29 | 3.4 |
| 876034 | 102 | 67 | 39 | 28 | 3.2 |
| 876081 | 80 | 69 | 56 | 29 | 4.2 |
| 876106 | 64 | 43 | 31 | 23 | 1.0 |
| 876203 | 60 | 40 | 23 | 7 | 0.8 |
| 876225 | 77 | 54 | 41 | 32 | 2.4 |
| 876249 | 81 | 69 | 37 | 33 | 3.1 |
| 876321 | 74 | 63 | 43 | 21 | 2.4 |
| 876540 | 90 | 69 | 44 | 22 | 3.1 |
| 876704 | 83 | 73 | 49 | 47 | 6.8 |
| 876731 | 70 | 49 | 39 | 40 | 2.1 |
| 877088 | 77 | 61 | 38 | 31 | 2.6 |
| 877112 | 65 | 52 | 28 | 17 | 1.2 |
| 877161 | 91 | 61 | 62 | 19 | 3.8 |
| 877289 | 73 | 55 | 34 | 20 | 1.7 |
| 877337 | 71 | 57 | 31 | 22 | 1.7 |

TABLE 67

Dose-dependent reduction of human LRRK2 expression in SH-SY5Y cells

| Compound Number | LRRK2 expression (% control) | | | | IC$_{50}$ (μM) |
|---|---|---|---|---|---|
| | 0.444 μM | 1.333 μM | 4.000 μM | 12.000 μM | |
| 780241 | 50 | 107 | 20 | 6 | n/a* |
| 876015 | 89 | 63 | 46 | 35 | 3.8 |
| 876039 | 64 | 52 | 30 | 29 | 1.3 |
| 876043 | 56 | 41 | 20 | 6 | 0.7 |
| 876091 | 90 | 59 | 30 | 20 | 2.1 |
| 876092 | 72 | 49 | 33 | 21 | 1.5 |
| 876093 | 58 | 97 | 31 | 27 | 3.1 |
| 876187 | 75 | 55 | 47 | 21 | 2.2 |
| 876235 | 72 | 51 | 28 | 20 | 1.4 |
| 876380 | 86 | 57 | 41 | 27 | 2.6 |
| 876639 | 76 | 62 | 42 | 35 | 3.0 |
| 876668 | 75 | 54 | 31 | 22 | 1.7 |
| 876732 | 77 | 52 | 44 | 24 | 2.2 |
| 876741 | 75 | 113 | 46 | 51 | 9.0 |
| 876852 | 70 | 53 | 38 | 28 | 1.8 |
| 877171 | 57 | 39 | 32 | 26 | 0.7 |
| 877395 | 62 | 35 | 22 | 26 | 0.7 |
| 877396 | 77 | 42 | 32 | 7 | 1.2 |
| 877587 | 108 | 83 | 48 | 46 | 6.7 |

*IC$_{50}$ value cannot be calculated

TABLE 68

Dose-dependent reduction of human LRRK2 expression in SH-SY5Y cells

| Compound Number | LRRK2 expression (% control) | | | | IC$_{50}$ (μM) |
|---|---|---|---|---|---|
| | 0.444 μM | 1.333 μM | 4.000 μM | 12.000 μM | |
| 780241 | 52 | 36 | 33 | 11 | 0.5 |
| 876119 | 80 | 67 | 42 | 22 | 2.8 |
| 876169 | 64 | 50 | 34 | 26 | 1.3 |
| 876239 | 71 | 44 | 29 | 23 | 1.2 |
| 876287 | 55 | 41 | 29 | 23 | 0.6 |
| 876334 | 64 | 51 | 44 | 37 | 2.0 |
| 876528 | 83 | 49 | 31 | 19 | 1.7 |
| 876649 | 78 | 60 | 37 | 32 | 2.5 |
| 876694 | 66 | 48 | 32 | 26 | 1.3 |
| 876912 | 68 | 48 | 25 | 30 | 1.2 |
| 876960 | 52 | 32 | 26 | 8 | 0.5 |
| 877102 | 67 | 48 | 30 | 32 | 1.3 |
| 877128 | 66 | 53 | 35 | 30 | 1.6 |
| 877198 | 73 | 52 | 35 | 17 | 1.6 |
| 877252 | 75 | 73 | 34 | 31 | 2.9 |
| 877326 | 50 | 40 | 33 | 12 | 0.5 |
| 877327 | 78 | 53 | 27 | 25 | 1.7 |
| 877349 | 47 | 41 | 33 | 24 | 0.3 |
| 877493 | 88 | 75 | 44 | 37 | 0.4 |

TABLE 69

Dose-dependent reduction of human LRRK2 expression in SH-SY5Y cells

| Compound Number | LRRK2 expression (% control) | | | | IC$_{50}$ (μM) |
| --- | --- | --- | --- | --- | --- |
| | 0.444 μM | 1.333 μM | 4.000 μM | 12.000 μM | |
| 780241 | 63 | 34 | 25 | 9 | 0.8 |
| 803643 | 49 | 59 | 54 | 32 | 1.7 |
| 876049 | 72 | 49 | 46 | 20 | 1.8 |
| 876074 | 54 | 32 | 28 | 7 | 0.5 |
| 876100 | 91 | 50 | 32 | 17 | 1.9 |
| 876124 | 61 | 37 | 17 | 23 | 0.7 |
| 876146 | 52 | 36 | 30 | 26 | 0.4 |
| 876170 | 78 | 48 | 41 | 25 | 1.9 |
| 876173 | 65 | 51 | 23 | 30 | 1.2 |
| 876244 | 71 | 52 | 29 | 31 | 1.6 |
| 876482 | 84 | 83 | 48 | 23 | 4.0 |
| 876553 | 79 | 54 | 32 | 23 | 1.8 |
| 876748 | 75 | 45 | 25 | 14 | 1.2 |
| 876821 | 83 | 64 | 40 | 26 | 2.8 |
| 877204 | 101 | 76 | 45 | 29 | 4.1 |
| 877305 | 63 | 41 | 28 | 17 | 0.9 |
| 877307 | 72 | 50 | 31 | 25 | 1.5 |
| 877496 | 71 | 59 | 34 | 24 | 1.9 |
| 877617 | 62 | 71 | 31 | 20 | 1.8 |

TABLE 70

Dose-dependent reduction of human LRRK2 expression in SH-SY5Y cells

| Compound Number | LRRK2 expression (% control) | | | | IC$_{50}$ (μM) |
| --- | --- | --- | --- | --- | --- |
| | 0.444 μM | 1.333 μM | 4.000 μM | 12.000 μM | |
| 780241 | 62 | 39 | 34 | 7 | 0.9 |
| 876054 | 72 | 74 | 42 | 27 | 3.0 |
| 876151 | 66 | 62 | 53 | 34 | 3.5 |
| 876175 | 95 | 48 | 36 | 29 | 2.3 |
| 876197 | 75 | 64 | 37 | 29 | 2.5 |
| 876318 | 68 | 58 | 39 | 16 | 1.7 |
| 876339 | 91 | 77 | 43 | 25 | 3.6 |
| 876414 | 77 | 52 | 48 | 25 | 2.4 |
| 876507 | 103 | 80 | 66 | 46 | 9.2 |
| 876607 | 79 | 57 | 43 | 25 | 2.4 |
| 876631 | 68 | 43 | 25 | 25 | 1.1 |
| 876727 | 93 | 79 | 59 | 32 | 5.6 |
| 876747 | 75 | 54 | 35 | 19 | 1.8 |
| 876867 | 71 | 54 | 25 | 13 | 1.3 |
| 877524 | 106 | 106 | 71 | 42 | 9.0 |
| 877573 | 75 | 59 | 36 | 28 | 2.1 |
| 877597 | 88 | 79 | 45 | 33 | 4.3 |
| 877644 | 94 | 67 | 41 | 45 | 4.8 |
| 877692 | 78 | 67 | 53 | 25 | 3.5 |

Example 9: Design of Gapmers with Mixed Internucleoside Linkages Complementary to Human LRRK2 RNA Modified oligonucleotides complementary to a human LRRK2 nucleic acid were designed. The modified oligonucleotides in Table 71 are gapmers. The gapmers have a central gap segment that comprises 2'-deoxynucleosides and is flanked by wing segments on both the 5' end on the 3' end comprising and cEt nucleosides and/or 2'-MOE nucleosides. All cytosine residues throughout each gapmer are 5'-methyl cytosines. The internucleoside linkages are mixed phosphodiester internucleoside linkages and phosphorothioate internucleoside linkages. The sequence and chemical notation column specifies the sequence, including 5'-methyl cytosines, sugar chemistry, and the internucleoside linkage chemistry, wherein subscript 'd' represents a 2'-deoxyribose sugar; subscript 'e' represents a 2'-MOE modified sugar; subscript 'k' represents a cEt modified sugar; subscript 'o' represents a phosphodiester internucleoside linkage; subscript 's' represents a phosphorothioate internucleoside linkage; and a 'm' superscript before the cytosine residue indicates a 5-methyl cytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the table below is complementary to human LRRK2 nucleic acid sequence SEQ ID NO: 1 or SEQ ID NO: 2, as indicated. 'N/A' indicates that the modified oligonucleotide is not complementary to that particular nucleic acid with 100% complementarity.

TABLE 71

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO |
| --- | --- | --- | --- | --- | --- | --- |
| 872246 | 3714 | 3733 | 82059 | 82078 | $G_{es}{}^mC_{eo}T_{eo}{}^mC_{es}A_{es}T_{ds}A_{ds}T_{ds}{}^mC_{ds}T_{ds}A_{ds}A_{ds}A_{ds}$ $G_{ds}A_{ds}{}^mC_{eo}{}^mC_{eo}G_{es}{}^mC_{es}A_{e}$ | 222 |
| 872247 | N/A | N/A | 52154 | 52173 | $G_{es}{}^mC_{eo}{}^mC_{eo}A_{es}A_{es}A_{ds}{}^mC_{ds}T_{ds}T_{ds}T_{ds}A_{ds}A_{ds}A_{ds}$ $G_{ds}A_{ds}T_{eo}G_{eo}{}^mC_{es}A_{es}G_{e}$ | 599 |
| 872248 | 3494 | 3513 | 77243 | 77262 | $A_{es}G_{eo}T_{eo}T_{es}{}^mC_{es}{}^mC_{ds}T_{ds}T_{ds}{}^mC_{ds}A_{ds}G_{ds}T_{ds}{}^m$ ${}^mC_{ds}T_{ds}{}^mC_{ds}A_{eo}A_{eo}G_{es}G_{es}G_{e}$ | 217 |
| 872249 | 7776 | 7795 | 145945 | 145964 | $G_{es}A_{eo}G_{eo}T_{es}A_{es}{}^mC_{ds}{}^mC_{ds}{}^mC_{ds}T_{ds}T_{ds}T_{ds}{}^mC_{ds}{}^m$ ${}^mC_{ds}A_{ds}T_{ds}G_{eo}T_{eo}G_{es}A_{es}A_{e}$ | 398 |
| 872250 | 988 | 1007 | 27963 | 27982 | ${}^mC_{es}{}^mC_{eo}A_{eo}{}^mC_{es}A_{es}A_{ds}A_{ds}{}^mC_{ds}T_{ds}T_{ds}{}^mC_{ds}A_{ds}$ $T_{ds}G_{ds}G_{ds}A_{ds}{}^mC_{eo}T_{eo}T_{es}{}^mC_{es}G_{e}$ | 293 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO |
|---|---|---|---|---|---|---|
| 872251 | 3714 | 3733 | 82059 | 82078 | $G_{es}{}^mC_{eo}T_{es}{}^mC_{es}A_{es}T_{ds}A_{ds}T_{ds}{}^mC_{ds}T_{ds}A_{ds}A_{ds}A_{ds}G_{ds}A_{ds}{}^mC_{eo}{}^mC_{eo}G_{es}{}^mC_{es}A_e$ | 222 |
| 872252 | N/A | N/A | 52154 | 52173 | $G_{es}{}^mC_{eo}{}^mC_{es}A_{es}A_{es}A_{ds}{}^mC_{ds}T_{ds}T_{ds}T_{ds}A_{ds}A_{ds}A_{ds}G_{ds}A_{ds}T_{eo}G_{eo}{}^mC_{es}A_{es}G_e$ | 599 |
| 872253 | 3494 | 3513 | 77243 | 77262 | $A_{es}G_{eo}T_{es}T_{es}{}^mC_{es}{}^mC_{ds}T_{ds}T_{ds}{}^mC_{ds}A_{ds}G_{ds}T_{ds}{}^mC_{ds}T_{ds}{}^mC_{ds}A_{eo}A_{eo}G_{es}G_{es}G_e$ | 217 |
| 872254 | 7776 | 7795 | 145945 | 145964 | $G_{es}A_{eo}G_{es}T_{es}A_{es}{}^mC_{ds}{}^mC_{ds}{}^mC_{ds}T_{ds}T_{ds}T_{ds}{}^mC_{ds}{}^mC_{ds}A_{ds}T_{ds}G_{eo}T_{eo}G_{es}A_{es}A_e$ | 398 |
| 872255 | 988 | 1007 | 27963 | 27982 | ${}^mC_{es}{}^mC_{eo}A_{es}{}^mC_{es}A_{es}A_{ds}A_{ds}{}^mC_{ds}T_{ds}{}^mC_{ds}A_{ds}T_{ds}G_{ds}G_{ds}A_{ds}{}^mC_{eo}T_{eo}T_{es}{}^mC_{es}G_e$ | 293 |
| 872256 | 3714 | 3733 | 82059 | 82078 | $G_{es}{}^mC_{eo}T_{es}{}^mC_{es}A_{es}T_{ds}A_{ds}T_{ds}{}^mC_{ds}T_{ds}A_{ds}A_{ds}A_{ds}A_{ds}G_{ds}A_{ds}{}^mC_{es}{}^mC_{eo}G_{es}{}^mC_{es}A_e$ | 222 |
| 872257 | N/A | N/A | 52154 | 52173 | $G_{es}{}^mC_{eo}{}^mC_{es}A_{es}A_{es}A_{ds}{}^mC_{ds}T_{ds}T_{ds}T_{ds}A_{ds}A_{ds}A_{ds}G_{ds}A_{ds}T_{es}G_{eo}{}^mC_{es}A_{es}G_e$ | 599 |
| 872258 | 3494 | 3513 | 77243 | 77262 | $A_{es}G_{eo}T_{es}T_{es}{}^mC_{es}{}^mC_{ds}T_{ds}T_{ds}{}^mC_{ds}A_{ds}G_{ds}T_{ds}{}^mC_{ds}T_{ds}{}^mC_{ds}A_{es}A_{eo}G_{es}G_{es}G_e$ | 217 |
| 872259 | 7776 | 7795 | 145945 | 145964 | $G_{es}A_{eo}G_{es}T_{es}A_{es}{}^mC_{ds}{}^mC_{ds}{}^mC_{ds}T_{ds}T_{ds}T_{ds}{}^mC_{ds}{}^mC_{ds}A_{ds}T_{ds}G_{es}T_{eo}G_{es}A_{es}A_e$ | 398 |
| 872260 | 988 | 1007 | 27963 | 27982 | ${}^mC_{es}{}^mC_{eo}A_{es}{}^mC_{es}A_{es}A_{ds}A_{ds}{}^mC_{ds}T_{ds}{}^mC_{ds}A_{ds}T_{ds}G_{ds}G_{ds}A_{ds}{}^mC_{es}T_{eo}T_{es}{}^mC_{es}G_e$ | 293 |
| 872261 | 3714 | 3733 | 82059 | 82078 | $G_{es}{}^mC_{es}T_{es}{}^mC_{es}A_{es}T_{ds}A_{ds}T_{ds}{}^mC_{ds}T_{ds}A_{ds}A_{ds}A_{ds}G_{ds}A_{ds}{}^mC_{es}{}^mC_{eo}G_{es}{}^mC_{es}A_e$ | 222 |
| 872262 | N/A | N/A | 52154 | 52173 | $G_{es}{}^mC_{es}{}^mC_{es}A_{es}A_{es}A_{ds}{}^mC_{ds}T_{ds}T_{ds}T_{ds}A_{ds}A_{ds}A_{ds}G_{ds}A_{ds}T_{es}G_{eo}{}^mC_{es}A_{es}G_e$ | 599 |
| 872263 | 3494 | 3513 | 77243 | 77262 | $A_{es}G_{es}T_{es}T_{es}{}^mC_{es}{}^mC_{ds}T_{ds}T_{ds}{}^mC_{ds}A_{ds}G_{ds}T_{ds}{}^mC_{ds}T_{ds}{}^mC_{ds}A_{es}A_{eo}G_{es}G_{es}G_e$ | 217 |
| 872264 | 7776 | 7795 | 145945 | 145964 | $G_{es}A_{es}G_{es}T_{es}A_{es}{}^mC_{ds}{}^mC_{ds}{}^mC_{ds}T_{ds}T_{ds}T_{ds}{}^mC_{ds}{}^mC_{ds}A_{ds}T_{ds}G_{es}T_{eo}G_{es}A_{es}A_e$ | 398 |
| 872265 | 988 | 1007 | 27963 | 27982 | ${}^mC_{es}{}^mC_{es}A_{es}{}^mC_{es}A_{es}A_{ds}A_{ds}{}^mC_{ds}T_{ds}{}^mC_{ds}A_{ds}T_{ds}G_{ds}G_{ds}A_{ds}{}^mC_{es}T_{eo}T_{es}{}^mC_{es}G_e$ | 293 |
| 872266 | 3712 | 3731 | 82057 | 82076 | $T_{es}{}^mC_{es}A_{es}T_{es}A_{es}T_{ds}{}^mC_{ds}T_{ds}A_{ds}A_{ds}A_{ds}G_{ds}A_{ds}{}^mC_{ds}{}^mC_{ds}G_{es}{}^mC_{eo}A_{es}A_{es}G_e$ | 1129 |
| 872267 | 3713 | 3732 | 82058 | 82077 | ${}^mC_{es}T_{eo}{}^mC_{es}A_{es}T_{es}A_{ds}T_{ds}{}^mC_{ds}T_{ds}A_{ds}A_{ds}A_{ds}G_{ds}A_{ds}{}^mC_{ds}{}^mC_{es}G_{eo}{}^mC_{es}A_{es}A_e$ | 1130 |
| 872268 | 3715 | 3734 | 82060 | 82079 | $T_{es}G_{eo}{}^mC_{es}T_{es}{}^mC_{es}A_{ds}T_{ds}A_{ds}T_{ds}{}^mC_{ds}T_{ds}A_{ds}A_{ds}A_{ds}G_{ds}A_{es}{}^mC_{eo}{}^mC_{es}G_{es}{}^mC_e$ | 1131 |
| 872269 | 3716 | 3735 | 82061 | 82080 | ${}^mC_{es}T_{eo}G_{es}{}^mC_{es}T_{es}{}^mC_{ds}A_{ds}T_{ds}A_{ds}T_{ds}{}^mC_{ds}T_{ds}A_{ds}A_{ds}A_{ds}G_{es}A_{eo}{}^mC_{es}{}^mC_{es}G_e$ | 1132 |
| 872270 | 3717 | 3736 | 82062 | 82081 | $G_{es}{}^mC_{eo}T_{es}G_{es}{}^mC_{es}T_{ds}{}^mC_{ds}A_{ds}T_{ds}A_{ds}T_{ds}{}^mC_{ds}T_{ds}A_{ds}A_{ds}A_{es}G_{eo}A_{es}{}^mC_{es}{}^mC_e$ | 1133 |
| 872271 | N/A | N/A | 52151 | 52170 | $A_{es}A_{eo}A_{es}{}^mC_{es}T_{es}T_{ds}T_{ds}A_{ds}A_{ds}A_{ds}G_{ds}A_{ds}T_{ds}G_{ds}{}^mC_{ds}A_{es}G_{eo}A_{es}A_{es}A_e$ | 1677 |
| 872272 | N/A | N/A | 52152 | 52171 | ${}^mC_{es}A_{eo}A_{es}A_{es}{}^mC_{es}T_{ds}T_{ds}T_{ds}A_{ds}A_{ds}A_{ds}G_{ds}A_{ds}T_{ds}G_{ds}{}^mC_{es}A_{eo}G_{es}A_{es}A_e$ | 1678 |
| 872273 | N/A | N/A | 52153 | 52172 | ${}^mC_{es}{}^mC_{eo}A_{es}A_{es}A_{es}{}^mC_{ds}T_{ds}T_{ds}T_{ds}A_{ds}A_{ds}G_{ds}A_{ds}T_{ds}G_{es}{}^mC_{eo}A_{es}G_{es}A_e$ | 1679 |
| 872274 | N/A | N/A | 52155 | 52174 | $T_{es}G_{eo}{}^mC_{es}{}^mC_{es}A_{es}A_{ds}A_{ds}{}^mC_{ds}T_{ds}T_{ds}T_{ds}A_{ds}A_{ds}A_{ds}G_{ds}A_{es}T_{eo}G_{es}{}^mC_{es}A_e$ | 1680 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO |
|---|---|---|---|---|---|---|
| 872275 | N/A | N/A | 52156 | 52175 | $T_{es}T_{eo}G_{es}{}^mC_{es}{}^mC_{es}A_{ds}A_{ds}A_{ds}{}^mC_{ds}T_{ds}T_{ds}T_{ds}A_{ds}A_{ds}A_{ds}G_{es}A_{eo}T_{es}G_{es}{}^mC_e$ | 1681 |
| 872276 | N/A | N/A | 52157 | 52176 | $T_{es}T_{eo}T_{es}G_{es}{}^mC_{es}{}^mC_{ds}A_{ds}A_{ds}A_{ds}{}^mC_{ds}T_{ds}T_{ds}T_{ds}A_{ds}A_{ds}A_{es}G_{eo}A_{es}T_{es}G_e$ | 1682 |
| 872277 | 3495 | 3514 | 77244 | 77263 | ${}^mC_{es}A_{eo}G_{es}T_{es}T_{es}{}^mC_{ds}{}^mC_{ds}T_{ds}T_{ds}{}^mC_{ds}A_{ds}G_{ds}T_{ds}{}^mC_{ds}T_{ds}{}^mC_{es}A_{eo}A_{es}G_{es}G_e$ | 1107 |
| 872278 | 3496 | 3515 | 77245 | 77264 | $T_{es}{}^mC_{eo}A_{es}G_{es}T_{es}T_{ds}{}^mC_{ds}{}^mC_{ds}T_{ds}T_{ds}{}^mC_{ds}A_{ds}G_{ds}T_{ds}{}^mC_{ds}T_{es}{}^mC_{eo}A_{es}A_{es}G_e$ | 1108 |
| 872279 | 3497 | 3516 | 77246 | 77265 | $T_{es}T_{eo}{}^mC_{es}A_{es}G_{es}T_{ds}T_{ds}{}^mC_{ds}{}^mC_{ds}T_{ds}T_{ds}{}^mC_{ds}A_{ds}G_{ds}T_{ds}{}^mC_{es}T_{eo}{}^mC_{es}A_{es}A_e$ | 1109 |
| 872280 | 7773 | 7792 | 145942 | 145961 | $T_{es}A_{eo}{}^mC_{es}{}^mC_{es}{}^mC_{es}T_{ds}T_{ds}T_{ds}{}^mC_{ds}{}^mC_{ds}A_{ds}T_{ds}G_{ds}T_{ds}G_{ds}A_{es}A_{eo}{}^mC_{es}A_{es}T_e$ | 1432 |
| 872281 | 7774 | 7793 | 145943 | 145962 | $G_{es}T_{eo}A_{es}{}^mC_{es}{}^mC_{es}{}^mC_{ds}T_{ds}T_{ds}T_{ds}{}^mC_{ds}{}^mC_{ds}A_{ds}T_{ds}G_{ds}T_{ds}G_{es}A_{eo}A_{es}{}^mC_{es}A_e$ | 1433 |
| 872282 | 7775 | 7794 | 145944 | 145963 | $A_{es}G_{eo}T_{es}A_{es}{}^mC_{es}{}^mC_{ds}{}^mC_{ds}T_{ds}T_{ds}T_{ds}{}^mC_{ds}{}^mC_{ds}A_{ds}T_{ds}G_{ds}T_{es}G_{eo}A_{es}A_{es}{}^mC_e$ | 1434 |
| 872283 | 7777 | 7796 | 145946 | 145965 | $T_{es}G_{eo}A_{es}G_{es}T_{es}A_{ds}{}^mC_{ds}{}^mC_{ds}{}^mC_{ds}T_{ds}T_{ds}T_{ds}{}^mC_{ds}{}^mC_{ds}A_{ds}T_{es}G_{eo}T_{es}G_{es}A_e$ | 1435 |
| 872284 | 7778 | 7797 | 145947 | 145966 | $G_{es}T_{eo}G_{es}A_{es}G_{es}T_{ds}A_{ds}{}^mC_{ds}{}^mC_{ds}{}^mC_{ds}T_{ds}T_{ds}T_{ds}{}^mC_{ds}{}^mC_{ds}A_{es}T_{eo}G_{es}T_{es}G_e$ | 1436 |
| 872285 | 7779 | 7798 | 145948 | 145967 | $T_{es}G_{eo}T_{es}G_{es}A_{es}G_{ds}T_{ds}A_{ds}{}^mC_{ds}{}^mC_{ds}{}^mC_{ds}T_{ds}T_{ds}T_{ds}{}^mC_{ds}{}^mC_{es}A_{eo}T_{es}G_{es}T_e$ | 1437 |
| 874144 | N/A | N/A | 82056 | 82075 | ${}^mC_{es}A_{eo}T_{eo}A_{eo}T_{es}{}^mC_{ds}T_{ds}A_{ds}A_{ds}A_{ds}G_{ds}A_{ds}{}^mC_{ds}{}^mC_{ds}G_{ds}{}^mC_{es}A_{eo}A_{es}G_{es}{}^mC_e$ | 3820 |
| 874145 | 3493 | 3512 | 77242 | 77261 | $G_{es}T_{eo}T_{eo}{}^mC_{eo}{}^mC_{es}T_{ds}T_{ds}{}^mC_{ds}A_{ds}G_{ds}T_{ds}{}^mC_{ds}T_{ds}{}^mC_{ds}A_{ds}A_{eo}G_{es}G_{es}G_e$ | 3821 |
| 874146 | 3492 | 3511 | 77241 | 77260 | $T_{es}T_{eo}{}^mC_{eo}{}^mC_{eo}T_{es}T_{ds}{}^mC_{ds}A_{ds}G_{ds}T_{ds}{}^mC_{ds}T_{ds}{}^mC_{ds}A_{ds}A_{ds}G_{eo}G_{eo}G_{es}G_e$ | 3822 |
| 874147 | 3491 | 3510 | 77240 | 77259 | $T_{es}{}^mC_{eo}{}^mC_{eo}T_{eo}T_{es}{}^mC_{ds}A_{ds}G_{ds}T_{ds}{}^mC_{ds}T_{ds}{}^mC_{ds}A_{ds}A_{ds}G_{ds}G_{eo}G_{eo}G_{es}A_e$ | 3823 |
| 874148 | 4117 | 4136 | 86612 | 86631 | $T_{es}{}^mC_{eo}A_{eo}T_{eo}A_{es}A_{ds}G_{ds}T_{ds}T_{ds}T_{ds}{}^mC_{ds}A_{ds}T_{ds}{}^mC_{ds}G_{eo}G_{eo}T_{es}T_{es}A_e$ | 3824 |
| 874149 | N/A | N/A | 82056 | 82075 | ${}^mC_{es}A_{eo}T_{es}A_{es}T_{es}{}^mC_{ds}T_{ds}A_{ds}A_{ds}A_{ds}G_{ds}A_{ds}{}^mC_{ds}{}^mC_{ds}G_{ds}{}^mC_{es}A_{eo}A_{es}G_{es}{}^mC_e$ | 3820 |
| 874150 | 3493 | 3512 | 77242 | 77261 | $G_{es}T_{eo}T_{es}{}^mC_{es}{}^mC_{es}T_{ds}T_{ds}{}^mC_{ds}A_{ds}G_{ds}T_{ds}{}^mC_{ds}T_{ds}{}^mC_{ds}A_{ds}A_{es}G_{eo}G_{es}G_{es}G_e$ | 3821 |
| 874151 | 3492 | 3511 | 77241 | 77260 | $T_{es}T_{eo}{}^mC_{es}{}^mC_{es}T_{es}T_{ds}{}^mC_{ds}A_{ds}G_{ds}T_{ds}{}^mC_{ds}T_{ds}{}^mC_{ds}A_{ds}A_{ds}G_{es}G_{eo}G_{es}G_e$ | 3822 |
| 890206 | N/A | N/A | 61977 | 61996 | ${}^mC_{es}T_{eo}T_{eo}T_{eo}{}^mC_{es}T_{ds}{}^mC_{ds}A_{ds}{}^mC_{ds}A_{ds}T_{ds}A_{ds}{}^mC_{ds}{}^mC_{ds}T_{ds}A_{eo}T_{eo}T_{es}A_{es}A_e$ | 3825 |
| 890207 | N/A | N/A | 61978 | 61997 | $T_{es}{}^mC_{eo}T_{eo}T_{eo}T_{es}{}^mC_{ds}T_{ds}{}^mC_{ds}A_{ds}{}^mC_{ds}A_{ds}T_{ds}A_{ds}{}^mC_{ds}{}^mC_{ds}T_{eo}A_{eo}T_{es}T_{es}A_e$ | 3826 |
| 890208 | N/A | N/A | 61979 | 61998 | ${}^mC_{es}T_{eo}{}^mC_{eo}T_{eo}T_{es}T_{ds}{}^mC_{ds}T_{ds}{}^mC_{ds}A_{ds}{}^mC_{ds}A_{ds}T_{ds}A_{ds}{}^mC_{ds}{}^mC_{eo}T_{eo}A_{es}T_{es}T_e$ | 3827 |
| 890209 | N/A | N/A | 61980 | 61999 | $T_{es}{}^mC_{eo}T_{eo}{}^mC_{eo}T_{es}T_{ds}T_{ds}{}^mC_{ds}T_{ds}{}^mC_{ds}A_{ds}{}^mC_{ds}A_{ds}T_{ds}A_{ds}{}^mC_{eo}{}^mC_{eo}T_{es}A_{es}T_e$ | 3828 |
| 934514 | 879 | 898 | 21710 | 21729 | $T_{es}G_{eo}{}^mC_{es}T_{es}T_{es}T_{ds}{}^mC_{ds}A_{ds}T_{ds}A_{ds}G_{ds}{}^mC_{ds}T_{ds}T_{ds}{}^mC_{ds}{}^mC_{es}A_{eo}{}^mC_{es}{}^mC_{es}A_e$ | 862 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO |
|---|---|---|---|---|---|---|
| 934515 | 880 | 899 | 21711 | 21730 | $A_{es}T_{eo}G_{es}{}^mC_{es}T_{es}T_{ds}T_{ds}{}^mC_{ds}A_{ds}T_{ds}A_{ds}G_{ds}{}^mC_{ds}T_{ds}T_{ds}{}^mC_{es}{}^mC_{eo}A_{es}{}^mC_{es}{}^mC_e$ | 863 |
| 934516 | 837 | 856 | 21668 | 21687 | $G_{es}{}^mC_{eo}{}^mC_{es}A_{es}{}^mC_{es}T_{ds}{}^mC_{ds}A_{ds}T_{ds}G_{ds}A_{ds}G_{ds}G_{ds}A_{ds}{}^mC_{ds}T_{es}T_{eo}{}^mC_{es}{}^mC_{es}A_e$ | 2833 |
| 934517 | 840 | 859 | 21671 | 21690 | $A_{es}T_{eo}T_{es}G_{es}{}^mC_{es}{}^mC_{ds}A_{ds}{}^mC_{ds}T_{ds}{}^mC_{ds}A_{ds}T_{ds}G_{ds}A_{ds}G_{ds}G_{es}A_{eo}{}^mC_{es}T_{es}T_e$ | 3362 |
| 934517 | 840 | 859 | 21671 | 21690 | $A_{es}T_{eo}T_{es}G_{es}{}^mC_{es}{}^mC_{ds}A_{ds}{}^mC_{ds}T_{ds}{}^mC_{ds}A_{ds}T_{ds}G_{ds}A_{ds}G_{ds}G_{es}A_{eo}{}^mC_{es}T_{es}T_e$ | 3362 |
| 934518 | 846 | 865 | 21677 | 21696 | ${}^mC_{es}{}^mC_{eo}T_{es}G_{es}A_{es}{}^mC_{ds}A_{ds}T_{ds}G_{ds}{}^mC_{ds}{}^mC_{ds}A_{ds}{}^mC_{ds}T_{ds}{}^mC_{es}A_{eo}T_{es}G_{es}A_e$ | 3514 |
| 934518 | 846 | 865 | 21677 | 21696 | ${}^mC_{es}{}^mC_{eo}T_{es}G_{es}A_{es}{}^mC_{ds}A_{ds}T_{ds}G_{ds}{}^mC_{ds}{}^mC_{ds}A_{ds}{}^mC_{ds}T_{ds}{}^mC_{es}A_{eo}T_{es}G_{es}A_e$ | 3514 |
| 934519 | N/A | N/A | 23873 | 23892 | $T_{es}G_{eo}{}^mC_{es}A_{es}T_{es}T_{ds}T_{ds}{}^mC_{ds}T_{ds}T_{ds}A_{ds}T_{ds}G_{ds}A_{ds}A_{es}A_{eo}A_{es}{}^mC_{es}A_e$ | 2706 |
| 934520 | 1233 | 1252 | 29584 | 29603 | $G_{es}A_{eo}G_{es}A_{es}T_{es}T_{ds}A_{ds}T_{ds}T_{ds}T_{ds}A_{ds}G_{ds}T_{ds}G_{ds}{}^mC_{ds}{}^mC_{es}{}^mC_{eo}A_{es}G_{es}{}^mC_e$ | 3287 |
| 934521 | 1426 | 1445 | 35373 | 35392 | $G_{es}T_{eo}A_{es}T_{es}T_{es}{}^mC_{ds}{}^mC_{ds}T_{ds}T_{ds}T_{ds}T_{ds}G_{ds}A_{ds}T_{ds}A_{ds}A_{es}{}^mC_{es}A_{es}G_{es}T_e$ | 917 |
| 934522 | 1435 | 1454 | 35382 | 35401 | ${}^mC_{es}A_{eo}T_{es}T_{es}{}^mC_{es}A_{ds}G_{ds}G_{ds}T_{ds}G_{ds}T_{ds}A_{ds}T_{ds}T_{ds}{}^mC_{ds}{}^mC_{es}T_{eo}T_{es}T_{es}T_e$ | 918 |
| 934523 | 1488 | 1507 | 35435 | 35454 | $G_{es}{}^mC_{eo}{}^mC_{es}A_{es}{}^mC_{es}T_{ds}T_{ds}T_{ds}{}^mC_{ds}A_{ds}G_{ds}{}^mC_{ds}{}^mC_{ds}A_{ds}{}^mC_{ds}T_{es}T_{eo}{}^mC_{es}A_{es}G_e$ | 922 |
| 934524 | 1700 | 1719 | 41933 | 41952 | $A_{es}{}^mC_{eo}{}^mC_{es}A_{es}T_{es}A_{ds}T_{ds}T_{ds}T_{ds}A_{ds}G_{ds}{}^mC_{ds}T_{ds}T_{ds}A_{ds}T_{es}G_{eo}A_{es}T_{es}G_e$ | 3670 |
| 934525 | 1701 | 1720 | 41934 | 41953 | $A_{es}A_{eo}{}^mC_{es}{}^mC_{es}A_{es}T_{ds}A_{ds}T_{ds}T_{ds}T_{ds}A_{ds}G_{ds}{}^mC_{ds}T_{ds}T_{ds}A_{es}T_{eo}G_{es}A_{es}T_e$ | 3365 |
| 934526 | N/A | N/A | 48094 | 48113 | $T_{es}G_{eo}{}^mC_{es}A_{es}T_{es}A_{ds}G_{ds}T_{ds}{}^mC_{ds}T_{ds}G_{ds}T_{ds}A_{ds}G_{ds}G_{ds}T_{es}A_{eo}G_{es}T_{es}A_e$ | 2260 |
| 934528 | 2267 | 2286 | 56275 | 56294 | ${}^mC_{es}T_{eo}G_{es}T_{es}T_{es}A_{ds}T_{ds}T_{ds}{}^mC_{ds}T_{ds}G_{ds}A_{ds}T_{ds}{}^mC_{ds}A_{ds}{}^mC_{es}A_{eo}{}^mC_{es}G_{es}{}^mC_e$ | 2685 |
| 934529 | 2452 | 2471 | 62073 | 62092 | $T_{es}G_{eo}T_{es}{}^mC_{es}A_{es}{}^mC_{ds}A_{ds}T_{ds}T_{ds}T_{ds}{}^mC_{ds}{}^mC_{ds}{}^mC_{ds}A_{ds}A_{ds}T_{es}G_{eo}{}^mC_{es}T_{es}T_e$ | 3366 |
| 934530 | 2453 | 2472 | 62074 | 62093 | ${}^mC_{es}T_{eo}G_{es}T_{es}{}^mC_{es}A_{ds}{}^mC_{ds}A_{ds}T_{ds}T_{ds}T_{ds}{}^mC_{ds}{}^mC_{ds}{}^mC_{ds}A_{ds}A_{es}T_{eo}G_{es}{}^mC_{es}T_e$ | 3443 |
| 934531 | 2454 | 2473 | 62075 | 62094 | $G_{es}{}^mC_{eo}T_{es}G_{es}T_{es}{}^mC_{ds}A_{ds}{}^mC_{ds}A_{ds}{}^mC_{ds}T_{ds}T_{ds}T_{ds}{}^mC_{ds}{}^mC_{ds}{}^mC_{ds}A_{es}A_{eo}T_{es}G_{es}{}^mC_e$ | 3518 |
| 934532 | 2456 | 2475 | 62077 | 62096 | $T_{es}G_{eo}G_{es}{}^mC_{es}T_{es}G_{ds}T_{ds}{}^mC_{ds}A_{ds}{}^mC_{ds}{}^mC_{ds}T_{ds}T_{ds}T_{ds}{}^mC_{ds}{}^mC_{ds}{}^mC_{es}{}^mC_{eo}A_{es}A_{es}T_e$ | 3595 |
| 934533 | 2363 | 2382 | 61984 | 62003 | ${}^mC_{es}T_{eo}G_{es}{}^mC_{es}T_{es}{}^mC_{ds}T_{ds}{}^mC_{ds}T_{ds}T_{ds}T_{ds}{}^mC_{ds}T_{ds}{}^mC_{ds}A_{ds}{}^mC_{es}A_{eo}T_{es}A_{es}{}^mC_e$ | 258 |
| 934534 | 2871 | 2890 | 71714 | 71733 | ${}^mC_{es}T_{eo}G_{es}T_{es}A_{es}A_{ds}T_{ds}A_{ds}{}^mC_{ds}G_{ds}G_{ds}{}^mC_{ds}A_{ds}T_{ds}{}^mC_{ds}T_{es}{}^mC_{es}{}^mC_{eo}G_{es}G_{es}T_e$ | 3140 |
| 934535 | N/A | N/A | 73941 | 73960 | ${}^mC_{es}A_{eo}G_{es}A_{es}T_{es}{}^mC_{ds}T_{ds}G_{ds}T_{ds}T_{ds}T_{ds}{}^mC_{ds}{}^mC_{ds}A_{ds}T_{ds}T_{es}G_{eo}{}^mC_{es}{}^mC_{es}T_e$ | 3636 |
| 934536 | 3582 | 3601 | 77331 | 77350 | $G_{es}G_{eo}{}^mC_{es}A_{es}{}^mC_{es}T_{ds}G_{ds}A_{ds}A_{ds}A_{ds}{}^mC_{ds}T_{ds}{}^mC_{ds}T_{ds}{}^mC_{ds}{}^mC_{es}A_{eo}{}^mC_{es}T_{es}T_e$ | 219 |
| 934537 | 3850 | 3869 | 82195 | 82214 | $G_{es}T_{eo}T_{es}T_{es}{}^mC_{es}T_{es}{}^mC_{ds}T_{ds}A_{ds}{}^mC_{ds}T_{ds}{}^mC_{ds}T_{ds}A_{ds}G_{ds}A_{es}{}^mC_{eo}{}^mC_{es}A_{es}T_e$ | 3369 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO |
|---|---|---|---|---|---|---|
| 934538 | 3852 | 3871 | 82197 | 82216 | $^mC_{es}A_{eo}G_{es}T_{es}T_{es}T_{es}{}^mC_{ds}T_{ds}{}^mC_{ds}T_{ds}A_{ds}{}^mC_{ds}T_{ds}{}^mC_{ds}T_{ds}A_{es}G_{eo}A_{es}{}^mC_{es}{}^mC_e$ | 3446 |
| 934540 | N/A | N/A | 91040 | 91059 | $A_{es}T_{eo}G_{es}T_{es}A_{es}T_{ds}{}^mC_{ds}T_{ds}{}^mC_{ds}T_{ds}T_{ds}A_{ds}A_{ds}{}^mC_{ds}{}^mC_{ds}{}^mC_{es}A_{eo}G_{es}A_{es}G_e$ | 1828 |
| 934541 | N/A | N/A | 91041 | 91060 | $^mC_{es}A_{eo}T_{es}G_{es}T_{es}A_{ds}T_{ds}{}^mC_{ds}T_{ds}{}^mC_{ds}T_{ds}T_{ds}A_{ds}A_{ds}{}^mC_{ds}{}^mC_{es}{}^mC_{eo}A_{es}G_{es}A_e$ | 1829 |
| 934542 | N/A | N/A | 91046 | 91065 | $G_{es}T_{eo}T_{es}T_{es}T_{es}{}^mC_{ds}A_{ds}T_{ds}G_{ds}T_{ds}A_{ds}T_{ds}{}^mC_{ds}T_{ds}{}^mC_{ds}T_{es}T_{eo}A_{es}A_{es}{}^mC_e$ | 1833 |
| 934543 | N/A | N/A | 91047 | 91066 | $T_{es}G_{eo}T_{es}T_{es}T_{es}T_{ds}{}^mC_{ds}A_{ds}T_{ds}G_{ds}T_{ds}A_{ds}T_{ds}{}^mC_{ds}T_{ds}{}^mC_{es}T_{eo}T_{es}A_{es}A_e$ | 1834 |
| 934544 | N/A | N/A | 91048 | 91067 | $^mC_{es}T_{eo}G_{es}T_{es}T_{es}T_{ds}T_{ds}{}^mC_{ds}A_{ds}T_{ds}G_{ds}T_{ds}A_{ds}T_{ds}{}^mC_{ds}T_{es}{}^mC_{eo}T_{es}T_{es}A_e$ | 1835 |
| 934545 | 4727 | 4746 | 92150 | 92169 | $G_{es}G_{eo}{}^mC_{es}A_{es}T_{ds}T_{ds}T_{ds}T_{ds}T_{ds}A_{ds}{}^mC_{ds}G_{ds}{}^mC_{ds}T_{es}{}^mC_{eo}{}^mC_{es}G_{es}A_e$ | 2690 |
| 934546 | 5073 | 5092 | 98221 | 98240 | $^mC_{es}T_{eo}G_{es}G_{es}A_{es}A_{ds}T_{ds}T_{ds}T_{ds}T_{ds}T_{ds}{}^mC_{ds}T_{ds}A_{ds}G_{ds}G_{es}A_{eo}G_{es}{}^mC_{es}T_e$ | 3524 |
| 934547 | N/A | N/A | 91042 | 91061 | $T_{es}{}^mC_{eo}A_{es}T_{es}G_{es}T_{ds}A_{ds}T_{ds}{}^mC_{ds}T_{ds}{}^mC_{ds}T_{ds}T_{ds}A_{ds}A_{ds}{}^mC_{es}{}^mC_{eo}{}^mC_{es}A_{es}G_e$ | 1830 |
| 934548 | 541 | 560 | 13807 | 13826 | $T_{es}A_{eo}{}^mC_{es}{}^mC_{es}T_{es}G_{ds}A_{ds}A_{ds}G_{ds}T_{ds}T_{ds}A_{ds}G_{ds}G_{ds}A_{ds}G_{es}G_{eo}G_{es}G_{es}A_e$ | 828 |
| 934549 | 540 | 559 | 13806 | 13825 | $A_{es}{}^mC_{eo}{}^mC_{es}T_{es}G_{es}A_{ds}A_{ds}G_{ds}T_{ds}T_{ds}A_{ds}G_{ds}G_{ds}A_{ds}G_{ds}G_{es}A_{eo}G_{es}A_{es}T_e$ | 827 |
| 934552 | 734 | 753 | 18633 | 18652 | $G_{es}{}^mC_{eo}A_{es}{}^mC_{es}T_{es}T_{ds}A_{ds}A_{ds}{}^mC_{ds}A_{ds}A_{ds}T_{ds}A_{ds}T_{ds}{}^mC_{ds}A_{es}T_{eo}A_{es}T_{es}A_e$ | 3513 |
| 934553 | 737 | 756 | 18636 | 18655 | $A_{es}A_{eo}{}^mC_{es}G_{es}{}^mC_{es}A_{ds}{}^mC_{ds}T_{ds}T_{ds}A_{ds}A_{ds}{}^mC_{ds}A_{ds}A_{ds}T_{ds}A_{es}T_{eo}{}^mC_{es}A_{es}T_e$ | 1997 |
| 934554 | 738 | 757 | 18637 | 18656 | $T_{es}A_{eo}A_{es}{}^mC_{es}G_{es}{}^mC_{ds}A_{ds}{}^mC_{ds}T_{ds}T_{ds}A_{ds}A_{ds}{}^mC_{ds}A_{ds}A_{ds}T_{es}A_{eo}T_{es}{}^mC_{es}A_e$ | 2073 |
| 934555 | 740 | 759 | 18639 | 18658 | $G_{es}T_{eo}T_{es}A_{es}A_{es}{}^mC_{ds}G_{ds}{}^mC_{ds}A_{ds}{}^mC_{ds}T_{ds}T_{ds}A_{ds}A_{ds}{}^mC_{ds}A_{es}A_{eo}T_{es}A_{es}T_e$ | 2148 |
| 934556 | 735 | 754 | 18634 | 18653 | $^mC_{es}G_{eo}{}^mC_{es}A_{es}{}^mC_{es}T_{ds}T_{ds}A_{ds}A_{ds}{}^mC_{ds}A_{ds}A_{ds}T_{ds}A_{ds}T_{ds}{}^mC_{es}A_{eo}T_{es}A_{es}T_e$ | 852 |
| 934557 | 736 | 755 | 18635 | 18654 | $A_{es}{}^mC_{eo}G_{es}{}^mC_{es}A_{es}{}^mC_{ds}T_{ds}T_{ds}A_{ds}A_{ds}{}^mC_{ds}A_{ds}A_{ds}T_{ds}A_{ds}T_{es}{}^mC_{eo}A_{es}T_{es}A_e$ | 3590 |
| 934558 | N/A | N/A | 19521 | 19540 | $A_{es}G_{eo}{}^mC_{es}A_{es}A_{es}T_{ds}{}^mC_{ds}A_{ds}T_{ds}T_{ds}G_{ds}G_{ds}T_{ds}A_{ds}G_{ds}{}^mC_{es}A_{eo}T_{es}A_{es}{}^mC_e$ | 3385 |
| 934584 | 7772 | 7791 | 145941 | 145960 | $A_{es}{}^mC_{eo}{}^mC_{es}{}^mC_{es}T_{es}T_{ds}T_{ds}{}^mC_{ds}mC_{ds}A_{ds}T_{ds}G_{ds}T_{ds}G_{ds}A_{ds}A_{es}{}^mC_{eo}A_{es}T_{es}T_e$ | 1431 |
| 934585 | 7780 | 7799 | 145949 | 145968 | $A_{es}T_{eo}G_{es}T_{es}G_{es}A_{ds}G_{ds}T_{ds}A_{ds}{}^mC_{ds}{}^mC_{ds}{}^mC_{ds}T_{ds}T_{ds}T_{ds}{}^mC_{es}{}^mC_{eo}A_{es}T_{es}G_e$ | 1438 |
| 934586 | 732 | 751 | 18631 | 18650 | $A_{es}{}^mC_{eo}T_{es}T_{es}A_{es}A_{ds}{}^mC_{ds}A_{ds}A_{ds}T_{ds}A_{ds}T_{ds}{}^mC_{ds}A_{ds}T_{ds}A_{es}T_{eo}A_{es}A_{es}T_e$ | 3361 |
| 934587 | 733 | 752 | 18632 | 18651 | $^mC_{es}A_{eo}{}^mC_{es}T_{es}T_{es}A_{ds}A_{ds}{}^mC_{ds}A_{ds}A_{ds}T_{ds}A_{ds}T_{ds}{}^mC_{ds}A_{ds}T_{es}A_{eo}T_{es}A_{es}A_e$ | 3438 |
| 934588 | 2451 | 2470 | 62072 | 62091 | $G_{es}T_{eo}{}^mC_{es}A_{es}{}^mC_{es}{}^mC_{ds}T_{ds}T_{ds}T_{ds}{}^mC_{ds}{}^mC_{ds}{}^mC_{ds}A_{ds}A_{ds}T_{ds}G_{es}{}^mC_{eo}T_{es}T_{es}A_e$ | 188 |
| 934589 | 835 | 854 | 21666 | 21685 | $^mC_{es}A_{eo}{}^mC_{es}T_{es}{}^mC_{es}A_{ds}T_{ds}G_{ds}A_{ds}G_{ds}G_{ds}A_{ds}{}^mC_{ds}T_{ds}T_{ds}{}^mC_{es}{}^mC_{eo}A_{es}{}^mC_{es}A_e$ | 860 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO |
|---|---|---|---|---|---|---|
| 934590 | 836 | 855 | 21667 | 21686 | $^mC_{es}{}^mC_{eo}A_{es}{}^mC_{es}T_{es}{}^mC_{ds}A_{ds}T_{ds}G_{ds}A_{ds}G_{ds}G_{ds}A_{ds}{}^mC_{ds}T_{ds}T_{es}{}^mC_{eo}{}^mC_{es}A_{es}{}^mC_e$ | 2757 |
| 934591 | 834 | 853 | 21665 | 21684 | $A_{es}{}^mC_{eo}T_{es}{}^mC_{es}A_{es}T_{ds}G_{ds}A_{ds}G_{ds}G_{ds}A_{ds}{}^mC_{ds}T_{ds}T_{ds}{}^mC_{ds}{}^mC_{es}A_{eo}{}^mC_{es}A_{es}T_e$ | 3286 |
| 934592 | 2362 | 2381 | 61983 | 62002 | $T_{es}G_{eo}{}^mC_{es}T_{es}{}^mC_{es}T_{ds}{}^mC_{ds}T_{ds}T_{ds}{}^mC_{ds}T_{ds}{}^mC_{ds}A_{ds}{}^mC_{ds}A_{es}T_{eo}A_{es}{}^mC_{es}{}^mC_e$ | 257 |
| 934593 | 896 | 915 | 21727 | 21746 | $^mC_{es}T_{eo}T_{es}T_{es}{}^mC_{es}A_{ds}{}^mC_{ds}T_{ds}{}^mC_{ds}A_{ds}T_{ds}A_{ds}G_{ds}G_{ds}A_{es}A_{eo}T_{es}G_{es}{}^mC_e$ | 291 |
| 934594 | 2365 | 2384 | 61986 | 62005 | $G_{es}A_{eo}{}^mC_{es}T_{es}G_{es}{}^mC_{ds}T_{ds}{}^mC_{ds}T_{ds}{}^mC_{ds}T_{ds}T_{ds}{}^mC_{ds}T_{ds}{}^mC_{es}A_{eo}{}^mC_{es}A_{es}T_e$ | 1017 |
| 934595 | 2364 | 2383 | 61985 | 62004 | $A_{es}{}^mC_{eo}T_{es}G_{es}{}^mC_{es}T_{ds}{}^mC_{ds}T_{ds}{}^mC_{ds}T_{ds}T_{ds}T_{ds}{}^mC_{ds}T_{ds}{}^mC_{ds}A_{es}{}^mC_{eo}A_{es}T_{es}A_e$ | 259 |
| 934596 | 542 | 561 | 13808 | 13827 | $T_{es}T_{eo}A_{es}{}^mC_{es}{}^mC_{es}T_{ds}G_{ds}A_{ds}A_{ds}G_{ds}T_{ds}T_{ds}A_{ds}G_{ds}G_{ds}A_{es}G_{eo}G_{es}A_{es}G_e$ | 829 |
| 934597 | 4112 | 4131 | 86607 | 86626 | $A_{es}G_{eo}T_{es}T_{es}{}^mC_{ds}A_{ds}T_{ds}T_{ds}{}^mC_{ds}G_{ds}G_{ds}T_{ds}T_{ds}A_{ds}T_{es}A_{eo}A_{es}G_{es}G_e$ | 1172 |
| 934599 | 2368 | 2387 | 61989 | 62008 | $T_{es}G_{eo}G_{es}G_{es}A_{es}{}^mC_{ds}T_{ds}G_{ds}{}^mC_{ds}T_{ds}{}^mC_{ds}T_{ds}{}^mC_{ds}T_{ds}T_{ds}T_{es}{}^mC_{eo}T_{es}{}^mC_{es}A_e$ | 185 |
| 934600 | 2369 | 2388 | 61990 | 62009 | $T_{es}T_{eo}G_{es}G_{es}G_{es}A_{ds}{}^mC_{ds}T_{ds}G_{ds}{}^mC_{ds}T_{ds}{}^mC_{ds}T_{ds}{}^mC_{ds}T_{ds}T_{es}T_{eo}{}^mC_{es}T_{es}{}^mC_e$ | 1019 |
| 952334 | 607 | 626 | 16127 | 16146 | $A_{es}G_{eo}T_{es}G_{es}{}^mC_{es}A_{ds}T_{ds}G_{ds}G_{ds}{}^mC_{ds}A_{ds}T_{ds}{}^mC_{ds}A_{ds}A_{ds}A_{es}A_{eo}A_{es}T_{es}T_e$ | 839 |
| 952335 | 730 | 749 | 18629 | 18648 | $T_{es}T_{eo}A_{es}A_{es}{}^mC_{es}A_{ds}A_{ds}T_{ds}A_{ds}A_{ds}T_{ds}{}^mC_{ds}A_{ds}T_{ds}A_{ds}A_{es}A_{eo}T_{es}{}^mC_{es}T_e$ | 3666 |
| 952336 | 872 | 891 | 21703 | 21722 | $A_{es}T_{eo}A_{es}G_{es}{}^mC_{es}T_{ds}T_{ds}{}^mC_{ds}{}^mC_{ds}A_{ds}{}^mC_{ds}{}^mC_{ds}A_{ds}{}^mC_{ds}A_{ds}A_{es}T_{eo}A_{es}T_{es}T_e$ | 1998 |
| 952338 | 875 | 894 | 21706 | 21725 | $T_{es}T_{eo}{}^mC_{es}A_{es}T_{es}A_{ds}G_{ds}{}^mC_{ds}T_{ds}T_{ds}{}^mC_{ds}{}^mC_{ds}A_{ds}{}^mC_{ds}{}^mC_{ds}A_{es}{}^mC_{eo}A_{es}A_{es}T_e$ | 2149 |
| 952340 | 877 | 896 | 21708 | 21727 | $^mC_{es}T_{eo}T_{es}T_{es}{}^mC_{es}A_{ds}T_{ds}A_{ds}G_{ds}{}^mC_{ds}T_{ds}T_{ds}{}^mC_{ds}{}^mC_{ds}A_{ds}{}^mC_{es}{}^mC_{eo}A_{es}{}^mC_{es}A_e$ | 2986 |
| 952358 | 3227 | 3246 | 76361 | 76380 | $A_{es}A_{eo}G_{es}T_{es}{}^mC_{es}{}^mC_{ds}A_{ds}A_{ds}A_{ds}T_{ds}G_{ds}T_{ds}G_{ds}T_{ds}{}^mC_{ds}A_{es}A_{eo}A_{es}{}^mC_{es}T_e$ | 2534 |
| 952359 | 3228 | 3247 | 76362 | 76381 | $^mC_{es}A_{eo}A_{es}G_{es}T_{es}{}^mC_{ds}{}^mC_{ds}A_{ds}A_{ds}A_{ds}T_{ds}G_{ds}T_{ds}G_{ds}T_{ds}{}^mC_{es}A_{eo}A_{es}A_{es}{}^mC_e$ | 2610 |
| 952360 | 3229 | 3248 | 76363 | 76382 | $G_{es}{}^mC_{eo}A_{es}A_{es}G_{es}T_{ds}{}^mC_{ds}{}^mC_{ds}A_{ds}A_{ds}A_{ds}T_{ds}G_{ds}T_{ds}G_{ds}T_{es}{}^mC_{eo}A_{es}A_{es}A_e$ | 2687 |
| 952361 | 3231 | 3250 | 76365 | 76384 | $G_{es}T_{eo}G_{es}{}^mC_{es}A_{es}A_{ds}G_{ds}T_{ds}{}^mC_{ds}{}^mC_{ds}A_{ds}A_{ds}A_{ds}T_{ds}G_{as}T_{es}G_{eo}T_{es}{}^mC_{es}A_e$ | 3141 |
| 952362 | 3498 | 3517 | 77247 | 77266 | $^mC_{es}T_{eo}T_{es}{}^mC_{es}A_{es}G_{ds}T_{ds}T_{ds}{}^mC_{ds}{}^mC_{ds}T_{ds}T_{ds}{}^mC_{ds}A_{ds}G_{ds}T_{es}{}^mC_{eo}T_{es}{}^mC_{es}A_e$ | 1110 |
| 952363 | 3499 | 3518 | 77248 | 77267 | $T_{es}{}^mC_{eo}T_{es}T_{es}{}^mC_{es}A_{ds}G_{ds}T_{ds}T_{ds}{}^mC_{ds}{}^mC_{ds}T_{ds}T_{ds}{}^mC_{ds}A_{ds}G_{es}T_{eo}{}^mC_{es}T_{es}{}^mC_e$ | 1111 |
| 952364 | 3505 | 3524 | 77254 | 77273 | $T_{es}T_{eo}A_{es}A_{es}A_{es}A_{ds}T_{ds}{}^mC_{ds}T_{ds}T_{ds}{}^mC_{ds}A_{ds}G_{ds}T_{ds}T_{ds}{}^mC_{es}{}^mC_{eo}T_{es}T_{es}{}^mC_e$ | 1112 |
| 952365 | 3718 | 3737 | 82063 | 82082 | $T_{es}G_{eo}{}^mC_{es}T_{es}G_{es}{}^mC_{ds}T_{ds}{}^mC_{ds}A_{ds}A_{ds}T_{ds}{}^mC_{ds}T_{ds}A_{ds}A_{es}A_{eo}G_{es}A_{es}{}^mC_e$ | 1134 |
| 952366 | 3719 | 3738 | 82064 | 82083 | $T_{es}T_{eo}G_{es}{}^mC_{es}T_{es}G_{ds}{}^mC_{ds}T_{ds}{}^mC_{ds}A_{ds}A_{ds}T_{ds}A_{ds}T_{ds}{}^mC_{ds}T_{ds}A_{es}A_{eo}A_{es}G_{es}A_e$ | 1135 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO |
|---|---|---|---|---|---|---|
| 952367 | 3723 | 3742 | 82068 | 82087 | $A_{es}T_{eo}{}^mC_{es}A_{es}T_{es}T_{ds}G_{ds}{}^mC_{ds}T_{ds}G_{ds}{}^mC_{ds}T_{ds}{}^mC_{ds}A_{ds}T_{ds}A_{es}T_{eo}{}^mC_{es}T_{es}A_e$ | 1136 |
| 952368 | 4106 | 4125 | 86601 | 86620 | $A_{es}T_{eo}T_{es}{}^mC_{es}G_{es}G_{ds}T_{ds}T_{ds}A_{ds}T_{ds}A_{ds}A_{ds}G_{ds}G_{ds}{}^mC_{ds}A_{es}{}^mC_{eo}A_{es}G_{es}{}^mC_e$ | 1167 |
| 952369 | 4107 | 4126 | 86602 | 86621 | ${}^mC_{es}A_{eo}T_{es}T_{es}{}^mC_{es}G_{ds}G_{ds}T_{ds}T_{ds}A_{ds}T_{ds}A_{ds}A_{ds}G_{ds}G_{ds}{}^mC_{es}A_{eo}{}^mC_{es}A_{es}G_e$ | 1168 |
| 952370 | 4108 | 4127 | 86603 | 86622 | $T_{es}{}^mC_{eo}A_{es}T_{es}T_{es}{}^mC_{ds}G_{ds}G_{ds}T_{ds}T_{ds}A_{ds}T_{ds}A_{ds}A_{ds}G_{ds}G_{es}{}^mC_{eo}A_{es}{}^mC_{es}A_e$ | 1169 |
| 952371 | 4109 | 4128 | 86604 | 86623 | $T_{es}T_{eo}{}^mC_{es}A_{es}T_{es}T_{ds}{}^mC_{ds}G_{ds}G_{ds}T_{ds}T_{ds}A_{ds}T_{ds}A_{ds}A_{ds}G_{es}G_{eo}{}^mC_{es}A_{es}{}^mC_e$ | 1170 |
| 952372 | 4110 | 4129 | 86605 | 86624 | $T_{es}T_{eo}T_{es}{}^mC_{es}A_{es}T_{ds}T_{ds}{}^mC_{ds}G_{ds}G_{ds}T_{ds}T_{ds}A_{ds}T_{ds}A_{ds}A_{es}G_{eo}G_{es}{}^mC_{es}A_e$ | 1171 |
| 952373 | 4111 | 4130 | 86606 | 86625 | $G_{es}T_{eo}T_{es}T_{es}{}^mC_{es}A_{ds}T_{ds}T_{ds}{}^mC_{ds}G_{ds}G_{ds}T_{ds}T_{ds}A_{ds}T_{ds}A_{es}A_{eo}G_{es}G_{es}{}^mC_e$ | 235 |
| 952374 | 4115 | 4134 | 86610 | 86629 | $A_{es}T_{eo}A_{es}A_{es}G_{es}T_{ds}T_{ds}T_{ds}{}^mC_{ds}A_{ds}T_{ds}T_{ds}{}^mC_{ds}G_{ds}G_{ds}T_{es}T_{eo}A_{es}T_{es}A_e$ | 1175 |
| 952375 | 608 | 627 | 16128 | 16147 | $G_{es}A_{eo}G_{es}T_{es}G_{es}{}^mC_{ds}A_{ds}T_{ds}G_{ds}G_{ds}{}^mC_{ds}A_{ds}T_{ds}{}^mC_{ds}A_{ds}A_{es}{}^mC_{eo}A_{es}A_{es}T_e$ | 279 |
| 952376 | 609 | 628 | 16129 | 16148 | $T_{es}G_{eo}A_{es}G_{es}T_{es}G_{ds}{}^mC_{ds}A_{ds}T_{ds}G_{ds}G_{ds}{}^mC_{ds}A_{ds}T_{ds}{}^mC_{ds}A_{ds}A_{es}{}^mC_{eo}A_{es}A_{es}A_e$ | 840 |
| 952377 | 610 | 629 | 16130 | 16149 | $A_{es}T_{eo}G_{es}A_{es}G_{es}T_{ds}G_{ds}{}^mC_{ds}A_{ds}T_{ds}G_{ds}G_{ds}{}^mC_{ds}A_{ds}T_{ds}{}^mC_{es}A_{eo}A_{es}A_{es}A_e$ | 841 |
| 952378 | 611 | 630 | 16131 | 16150 | $A_{es}A_{eo}T_{es}G_{es}A_{es}G_{ds}T_{ds}G_{ds}{}^mC_{ds}A_{ds}T_{ds}G_{ds}G_{ds}{}^mC_{ds}A_{ds}T_{es}{}^mC_{eo}A_{es}A_{es}A_e$ | 280 |
| 952379 | 612 | 631 | 16132 | 16151 | $A_{es}A_{eo}A_{es}T_{es}G_{es}A_{ds}G_{ds}T_{ds}G_{ds}{}^mC_{ds}A_{ds}T_{ds}G_{ds}G_{ds}{}^mC_{ds}A_{es}T_{eo}{}^mC_{es}A_{es}A_e$ | 842 |
| 952380 | 613 | 632 | 16133 | 16152 | $G_{es}A_{eo}A_{es}A_{es}T_{es}G_{ds}A_{ds}G_{ds}T_{ds}G_{ds}{}^mC_{ds}A_{ds}T_{ds}G_{ds}G_{ds}{}^mC_{es}A_{eo}T_{es}{}^mC_{es}A_e$ | 843 |
| 952381 | 620 | 639 | 16140 | 16159 | $T_{es}T_{eo}G_{es}G_{es}{}^mC_{es}T_{ds}G_{ds}G_{ds}A_{ds}A_{ds}A_{ds}T_{ds}G_{ds}A_{ds}G_{ds}T_{es}G_{eo}{}^mC_{es}A_{es}T_e$ | 844 |
| 953599 | 732 | 748 | 18631 | 18647 | $T_{es}A_{eo}A_{eo}{}^mC_{es}A_{ds}A_{ds}T_{ds}A_{ds}T_{ds}{}^mC_{ds}A_{ds}T_{ds}A_{ds}Tk_oA_{es}A_{es}T_e$ | 3829 |
| 953600 | 733 | 749 | 18632 | 18648 | $T_{es}T_{eo}A_{eo}A_{es}{}^mC_{ds}A_{ds}A_{ds}T_{ds}A_{ds}T_{ds}{}^mC_{ds}A_{ds}T_{ds}Ak_oT_{es}A_{es}A_e$ | 3830 |
| 953601 | 734 | 750 | 18633 | 18649 | ${}^mC_{es}T_{eo}T_{eo}A_{es}A_{ds}{}^mC_{ds}A_{ds}A_{ds}T_{ds}A_{ds}T_{ds}{}^mC_{ds}A_{ds}Tk_oA_{es}T_{es}A_e$ | 3831 |
| 953602 | 735 | 751 | 18634 | 18650 | $A_{es}{}^mC_{eo}T_{eo}T_{es}A_{ds}A_{ds}{}^mC_{ds}A_{ds}A_{ds}T_{ds}A_{ds}T_{ds}{}^mC_{ds}Ak_oT_{es}A_{es}T_e$ | 3832 |
| 953603 | 736 | 752 | 18635 | 18651 | ${}^mC_{es}A_{eo}{}^mC_{eo}T_{es}T_{ds}A_{ds}A_{ds}{}^mC_{ds}A_{ds}A_{ds}T_{ds}A_{ds}T_{ds}Ck_oA_{es}T_{es}A_e$ | 3833 |
| 953604 | 1874 | 1890 | 52788 | 52804 | $A_{es}G_{eo}{}^mC_{eo}A_{es}{}^mC_{ds}T_{ds}G_{ds}A_{ds}A_{ds}T_{ds}{}^mC_{ds}{}^mC_{ds}A_{ds}Tk_oA_{es}G_{es}{}^mC_e$ | 3834 |
| 953605 | 1791 | 1807 | 52705 | 52721 | $A_{es}{}^mC_{eo}A_{eo}T_{es}T_{ds}T_{ds}{}^mC_{ds}T_{ds}G_{ds}A_{ds}A_{ds}T_{ds}{}^mC_{ds}Ck_{om}C_{es}A_{es}G_e$ | 3835 |
| 953606 | 3493 | 3509 | 77242 | 77258 | ${}^mC_{es}{}^mC_{eo}T_{eo}T_{es}{}^mC_{ds}A_{ds}G_{ds}T_{ds}{}^mC_{ds}T_{ds}{}^mC_{ds}A_{ds}A_{ds}Gk_oG_{es}G_{es}G_e$ | 3836 |
| 953607 | 3713 | 3729 | 82058 | 82074 | $A_{es}T_{eo}A_{eo}T_{es}{}^mC_{ds}T_{ds}A_{ds}A_{ds}A_{ds}G_{ds}A_{ds}{}^mC_{ds}{}^mC_{ds}Gk_o{}^mC_{es}A_{es}A_e$ | 3837 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO |
|---|---|---|---|---|---|---|
| 953608 | 987 | 1003 | 27962 | 27978 | $A_{es}A_{eo}A_{eo}{}^mC_{es}T_{ds}{}^mC_{ds}A_{ds}T_{ds}G_{ds}G_{ds}A_{ds}{}^mC_{ds}T_{ds}Tk_o{}^mC_{es}G_{es}T_e$ | 3838 |
| 953609 | 4110 | 4126 | 86605 | 86621 | ${}^mC_{es}A_{eo}T_{eo}T_{es}{}^mC_{ds}G_{ds}G_{ds}T_{ds}T_{ds}A_{ds}T_{ds}A_{ds}A_{ds}Gk_oG_{es}{}^mC_{es}A_e$ | 3839 |
| 953610 | 7775 | 7791 | 145944 | 145960 | $A_{es}{}^mC_{eo}{}^mC_{eo}{}^mC_{es}T_{ds}T_{ds}T_{ds}{}^mC_{ds}{}^mC_{ds}A_{ds}T_{ds}G_{ds}T_{ds}Gk_oA_{es}A_{es}{}^mC_e$ | 3840 |
| 953611 | 879 | 895 | 21710 | 21726 | $T_{es}T_{eo}T_{eo}{}^mC_{es}A_{ds}T_{ds}A_{ds}G_{as}{}^mC_{ds}T_{as}T_{as}{}^mC_{ds}{}^mC_{ds}Ak_o{}^mC_{es}{}^mC_{es}A_e$ | 3841 |
| 953612 | 834 | 850 | 21665 | 21681 | ${}^mC_{es}A_{eo}T_{eo}G_{es}A_{ds}G_{ds}G_{ds}A_{ds}{}^mC_{ds}T_{ds}T_{ds}{}^mC_{ds}{}^mC_{ds}Ak_o{}^mC_{es}A_{es}T_e$ | 3842 |
| 953613 | 606 | 622 | 16126 | 16142 | ${}^mC_{es}A_{eo}T_{eo}G_{es}G_{ds}{}^mC_{ds}A_{ds}T_{as}{}^mC_{ds}A_{ds}A_{ds}A_{ds}A_{ds}Ak_oT_{es}T_{es}A_e$ | 3843 |
| 953614 | 990 | 1006 | 27965 | 27981 | ${}^mC_{es}A_{eo}{}^mC_{eo}A_{es}A_{ds}A_{ds}{}^mC_{ds}T_{ds}{}^mC_{ds}A_{ds}T_{ds}G_{ds}G_{ds}Ak_o{}^mC_{es}T_{es}T_e$ | 3844 |
| 953615 | 3497 | 3513 | 77246 | 77262 | $A_{es}G_{eo}T_{eo}T_{es}{}^mC_{ds}{}^mC_{ds}T_{ds}T_{ds}{}^mC_{ds}A_{ds}G_{ds}T_{ds}{}^mC_{ds}Tk_o{}^mC_{es}A_{es}A_e$ | 3845 |
| 953616 | 4108 | 4124 | 86603 | 86619 | $T_{es}T_{eo}{}^mC_{eo}G_{es}G_{as}T_{ds}T_{ds}A_{ds}T_{as}A_{ds}A_{ds}G_{ds}G_{as}{}^mCk_oA_{es}{}^mC_{es}A_e$ | 3846 |
| 953617 | 1698 | 1714 | 41931 | 41947 | $A_{es}T_{eo}T_{eo}T_{es}A_{ds}G_{ds}{}^mC_{ds}T_{ds}T_{ds}A_{ds}T_{ds}G_{ds}A_{ds}Tk_oG_{es}A_{es}A_e$ | 3847 |

Example 10: Effect of 5-10-5 MOE Gapmers with Mixed Internucleoside Linkages on Human LRRK2 RNA Expression In Vitro Via Free Uptake Modified oligonucleotides selected from the examples above were tested at various doses in A431 cells by free uptake. Cells were plated at a density of 10,000 cells per well with 0.039, 0.156, 0.625, 2.500 and 10.000 µM concentrations of modified oligonucleotide, as specified in the tables below. After a treatment period of approximately 24 hours, total RNA was isolated from the cells and LRRK2 RNA levels were measured by quantitative real-time PCR. Human LRRK2 primer probe set RTS3132 (described herein in Example 2) was used to measure RNA levels. LRRK2 RNA levels were adjusted according to total RNA content, as measured by RIBOGREEN®. Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response—variable slope (4 parameters)" formula using Prism6 software.

TABLE 72

Dose-dependent reduction of human LRRK2 expression in A431 cells by free uptake

| Compound Number | LRRK2 expression (% control) | | | | | IC$_{50}$ (µM) |
|---|---|---|---|---|---|---|
| | 0.039 µM | 0.156 µM | 0.625 µM | 2.500 µM | 10.000 µM | |
| 780160 | 101 | 86 | 56 | 55 | 48 | 4.5 |
| 780161 | 102 | 85 | 58 | 31 | 45 | 1.9 |
| 780164 | 95 | 75 | 63 | 52 | 40 | 3.1 |
| 780166 | 94 | 42 | 42 | 31 | 32 | 0.4 |
| 780241 | 70 | 70 | 46 | 35 | 50 | 1.3 |
| 802655 | 81 | 76 | 58 | 52 | 36 | 2.3 |
| 802665 | 78 | 73 | 62 | 59 | 53 | 14.3 |
| 802678 | 77 | 44 | 28 | 24 | 26 | 0.2 |
| 802714 | 84 | 84 | 64 | 47 | 40 | 2.8 |
| 802758 | 84 | 51 | 25 | 23 | 29 | 0.2 |
| 802770 | 74 | 68 | 44 | 28 | 31 | 0.5 |
| 802784 | 88 | 70 | 37 | 20 | 25 | 0.5 |
| 802938 | 109 | 53 | 50 | 38 | 34 | 1.0 |
| 802939 | 96 | 80 | 63 | 44 | 31 | 1.9 |
| 802963 | 92 | 102 | 88 | 78 | 64 | 26.0 |
| 803000 | 85 | 84 | 60 | 30 | 33 | 1.3 |
| 803006 | 89 | 77 | 53 | 43 | 37 | 1.7 |
| 803268 | 90 | 93 | 55 | 46 | 27 | 1.7 |
| 803270 | 86 | 80 | 52 | 44 | 43 | 2.2 |
| 872255 | 96 | 67 | 36 | 29 | 22 | 0.5 |
| 872260 | 52 | 55 | 33 | 23 | 29 | 0.1 |
| 876031 | 96 | 60 | 33 | 21 | 20 | 0.4 |
| 876180 | 101 | 94 | 90 | 90 | 80 | >300 |
| 876190 | 81 | 68 | 36 | 24 | 23 | 0.4 |
| 876604 | 91 | 71 | 46 | 28 | 41 | 0.0 |
| 934517 | 80 | 86 | 43 | 38 | 48 | 0.9 |
| 934518 | 82 | 54 | 28 | 25 | 31 | 1.8 |
| 934523 | 71 | 49 | 30 | 15 | 23 | 0.3 |
| 934528 | 71 | 57 | 50 | 26 | 34 | 0.2 |
| 934529 | 76 | 43 | 24 | 27 | 29 | 0.4 |
| 934530 | 89 | 68 | 40 | 28 | 25 | 0.2 |

TABLE 72-continued

Dose-dependent reduction of human LRRK2 expression in A431 cells by free uptake

| Compound Number | LRRK2 expression (% control) | | | | | IC$_{50}$ (µM) |
|---|---|---|---|---|---|---|
| | 0.039 µM | 0.156 µM | 0.625 µM | 2.500 µM | 10.000 µM | |
| 934553 | 99 | 73 | 51 | 33 | 31 | 0.6 |
| 934554 | 95 | 73 | 72 | 40 | 35 | 1.0 |
| 934556 | 63 | 59 | 41 | 26 | 28 | 2.1 |
| 934557 | 107 | 63 | 51 | 33 | 33 | 0.3 |

Example 11: Effect of Modified Oligonucleotides on Rhesus Monkey LRRK2 RNA In Vitro, Multiple Doses Modified oligonucleotides selected from the examples above, which are also complementary to rhesus monkey LRRK2 were tested at various doses in LLC-MK2 monkey cells. Cells were plated at a density of 20,000 cells per well and transfected using electroporation with 0.011, 0.034, 0.103, 0.309, 0.926, 2.778, 8.333, and 25.000 µM concentrations of modified oligonucleotide, as specified in the tables below. Also tested were control oligonucleotides, 676630, a 5-10-5 MOE gapmer with mixed phosphodiester and phosphorothioate backbone with no known target and the sequence CCTATAGGACTATCCAGGAA (SEQ ID NO: 3848). After a treatment period of approximately 24 hours, total RNA was isolated from the cells and LRRK2 RNA levels were measured by quantitative real-time PCR. Human LRRK2 primer probe set hLRRK2 LTS35700 (forward sequence CCAGGTACAATGCAAAGCTTAAT, designated herein as SEQ ID NO: 20; reverse sequence TCAGTCCAATCACTGACAAGTT, designated herein as SEQ ID NO: 21; probe sequence TTGG-GAAGTCCTTGGTGTTCACCA, designated herein as SEQ ID NO: 22) was used to measure RNA levels. LRRK2 RNA levels were adjusted according to total RNA content, as measured by RIBOGREEN Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response—variable slope (4 parameters)" formula using Prism6 software.

TABLE 73

Dose-dependent reduction of human LRRK2 expression in LLC-MK2 rhesus monkey cells

| Compound Number | LRRK2 expression (% control) | | | | | | | | IC$_{50}$ (µM) |
|---|---|---|---|---|---|---|---|---|---|
| | 0.011 µM | 0.034 µM | 0.103 µM | 0.309 µM | 0.926 µM | 2.778 µM | 8.333 µM | 25.000 µM | |
| 676630 | 118 | 114 | 124 | 128 | 123 | 134 | 125 | 125 | n/a# |
| 780241 | 114 | 118 | 116 | 92 | 67 | 51 | 46 | 41 | 6.4 |
| 802714** | 122 | 116 | 130 | 131 | 112 | 80 | 41 | 20 | 7.4 |
| 803268* | 101 | 109 | 105 | 112 | 108 | 89 | 76 | 69 | 50.4 |
| 876031 | 122 | 113 | 106 | 84 | 46 | 14 | 8 | 1 | 0.9 |
| 876604** | 97 | 95 | 99 | 97 | 107 | 107 | 105 | 77 | n/a# |
| 934556 | 88 | 84 | 71 | 55 | 30 | 12 | 11 | 6 | 0.3 |

IC$_{50}$ value cannot be calculated
*This modified oligonucleotide is complementary to and contains one mismatch to rhesus monkey LRRK2 nucleic acid SEQ ID NO: 3
**These modified oligonucleotides are complementary to and contain two mismatches to rhesus monkey LRRK2 nucleic acid SEQ ID NO: 3

Example 12: Effect of Modified Oligonucleotides on Human LRRK2 RNA Expression In Vitro, Multiple Doses Modified oligonucleotides described above were tested at various doses in SH-SY5Y cells. Cells were plated at a density of 20,000 cells per well and transfected using electroporation with 0.011, 0.034, 0.103, 0.309, 0.926, 2.778, 8.333, and 25.000 µM of modified oligonucleotide, as specified in the tables below. Also tested was control oligonucleotide, 676630, a 5-10-5 MOE gapmer with mixed phosphodiester and phosphorothioate backbone with no known target. After a treatment period of approximately 24 hours, total RNA was isolated from the cells and LRRK2 RNA levels were measured by quantitative real-time PCR. Human LRRK2 primer probe set LTS35700 (described herein in Example 11) was used to measure RNA levels. LRRK2 RNA levels were adjusted according to total RNA content, as measured by RIBOGREEN Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response—variable slope (4 parameters)" formula using Prism6 software.

TABLE 74

Dose-dependent reduction of human LRRK2 expression in SH-SY5Y Cells

| Compound Number | LRRK2 expression (% control) | | | | | | | | IC$_{50}$ (µM) |
|---|---|---|---|---|---|---|---|---|---|
| | 0.011 µM | 0.034 µM | 0.103 µM | 0.309 µM | 0.926 µM | 2.778 µM | 8.333 µM | 25.000 µM | |
| Control 676630 | 129 | 113 | 108 | 133 | 109 | 131 | 122 | 133 | n/a* |
| 780241 | 117 | 104 | 92 | 93 | 76 | 59 | 58 | 58 | n/a* |
| 802714 | 100 | 123 | 98 | 93 | 75 | 56 | 44 | 36 | 6.3 |
| 803268 | 99 | 121 | 96 | 83 | 77 | 84 | 73 | 68 | 105.6 |
| 876031 | 96 | 99 | 93 | 73 | 49 | 22 | 18 | 15 | 1.0 |
| 876604 | 97 | 91 | 78 | 65 | 43 | 20 | 15 | 15 | 0.6 |
| 934556 | 97 | 90 | 77 | 55 | 42 | 27 | 20 | 15 | 0.6 |

*IC$_{50}$ value cannot be calculated

Example 13: Activity of Modified Oligonucleotides Complementary to Human LRRK2 in Transgenic Mice, Two Week Assessment Modified oligonucleotides described above were tested in the human BAC wild type LRRK2 transgenic mouse model (B6; SJL-Tg(LRRK2)66Mjff/J; Stock No: 013725, The Jackson Laboratory) to assess activity after two weeks. Mice hemizygous for the BAC LRRK2-Wt transgene are viable and fertile. These mice express a wild-type human leucine-rich repeat kinase 2 (LRRK2) gene directed by the human LRRK2 promoter/enhancer regions on the BAC transgene (Ouyang Y et al., 2011). Mice from this model express human LRRK2 in a variety of tissues, including the spinal cord and brain.

Treatment

LRRK2 transgenic mice each received a single intracerebroventricular (ICV) dose of 300 µg of modified oligonucleotides listed in the table below. Each treatment group consisted of 4 mice. A group of 4 mice received PBS as a negative control.

RNA Analysis

After two weeks, mice were sacrificed and RNA was extracted from cortical brain tissue and spinal cord for real-time PCR analysis of measurement of RNA expression of LRRK2 using primer probe set hLRRK2 LTS35700 (described herein above in Example 11). Results are presented in the table below as percent LRRK2 RNA levels relative to relative to PBS control, normalized with cyclophilin A As shown in the table below, treatment with modified oligonucleotides resulted in reduction of human LRRK2 RNA in comparison to the PBS control.

TABLE 75

Reduction of human LRRK2 RNA in transgenic mice

| Compound Number | LRRK2 Expression (% control) | |
|---|---|---|
| | Cortex | Spinal Cord |
| PBS | 100 | 100 |
| 693430 | 46 | 37 |
| 725607 | 24 | 50 |
| 725608 | 19 | 33 |
| 725609 | 30 | 37 |
| 780162 | 59 | 76 |
| 780164 | 27 | 62 |
| 780166 | 14 | 26 |
| 780189 | 58 | 49 |
| 780202 | 42 | 36 |
| 780203 | 65 | 66 |
| 780205 | 13 | 29 |
| 780219 | 34 | 43 |
| 780236 | 19 | 29 |
| 780241 | 23 | 38 |
| 780243 | 54 | 47 |
| 780254 | 42 | 41 |
| 780284 | 61 | 53 |
| 780321 | 39 | 64 |
| 780347 | 42 | 51 |
| 780549 | 63 | 53 |
| 780602 | 93 | 103 |
| 780620 | 47 | 45 |
| 780624 | 63 | 75 |
| 780649 | 52 | 48 |
| 780685 | 42 | 37 |
| 802655 | 30 | 48 |
| 802678 | 7 | 26 |
| 802685 | 38 | 32 |
| 802686 | 17 | 40 |
| 802688 | 18 | 27 |
| 802689 | 16 | 36 |
| 802731 | 42 | 44 |
| 802746 | 42 | 64 |
| 802747 | 56 | 44 |
| 802748 | 32 | 25 |
| 802845 | 30 | 26 |
| 802846 | 35 | 41 |
| 802848 | 68 | 72 |

TABLE 76

Reduction of human LRRK2 RNA in transgenic mice

| Compound Number | LRRK2 Expression (% control) | |
|---|---|---|
| | Cortex | Spinal Cord |
| PBS | 100 | 100 |
| 802849 | 78 | 77 |
| 802850 | 73 | 92 |
| 802888 | 49 | 63 |
| 802911 | 80 | 92 |
| 802915 | 54 | 68 |
| 802935 | 69 | 61 |
| 802936 | 40 | 52 |
| 802937 | 43 | 40 |
| 802958 | 57 | 78 |
| 802960 | 54 | 48 |
| 802961 | 34 | 44 |

TABLE 76-continued

Reduction of human LRRK2 RNA in transgenic mice

| Compound Number | LRRK2 Expression (% control) Cortex | Spinal Cord |
|---|---|---|
| 802962 | 40 | 51 |
| 802974 | 50 | 55 |
| 803002 | 30 | 44 |
| 803003 | 67 | 85 |
| 803004 | 73 | 86 |
| 803005 | 66 | 65 |
| 803046 | 95 | 65 |
| 803065 | 55 | 52 |
| 802959 | 41 | 62 |
| 803075 | 38 | 54 |
| 803102 | 89 | 89 |
| 803112 | 40 | 51 |
| 803122 | 52 | 71 |
| 803386 | 73 | 80 |
| 803515 | 81 | 104 |
| 803516 | 63 | 81 |
| 803517 | 55 | 67 |
| 803518 | 60 | 85 |
| 803519 | 70 | 79 |
| 803520 | 50 | 80 |
| 803571 | 66 | 71 |
| 803595 | 80 | 71 |
| 803604 | 65 | 67 |
| 803629 | 57 | 72 |
| 803682 | 47 | 46 |
| 803744 | 47 | 53 |
| 803770 | 73 | 54 |
| 803771 | 53 | 46 |
| 803773 | 40 | 50 |
| 803782 | 80 | 96 |

TABLE 77

Reduction of human LRRK2 RNA in transgenic mice

| Compound Number | LRRK2 Expression (% control) Cortex | Spinal Cord |
|---|---|---|
| PBS | 100 | 100 |
| 780160 | 13 | 15 |
| 780161 | 24 | 30 |
| 802665 | 17 | 35 |
| 802678 | 27 | 35 |
| 802690 | 33 | 40 |
| 802714 | 21 | 47 |
| 802758 | 23 | 42 |
| 802770 | 11 | 22 |
| 802781 | 32 | 49 |
| 802784 | 16 | 30 |
| 802938 | 21 | 32 |
| 802939 | 13 | 41 |
| 802963 | 26 | 51 |
| 803000 | 22 | 42 |
| 803001 | 36 | 50 |
| 803006 | 29 | 39 |
| 803268 | 31 | 52 |
| 803269 | 38 | 49 |
| 803270 | 24 | 75 |
| 803271 | 31 | 48 |
| 803272 | 76 | 75 |
| 803273 | 77 | 70 |
| 803274 | 50 | 65 |

TABLE 78

Reduction of human LRRK2 RNA in transgenic mice

| Compound Number | LRRK2 Expression (% control) Cortex | Spinal Cord |
|---|---|---|
| PBS | 100 | 100 |
| 802678 | 24 | 19 |
| 803275 | 52 | 77 |
| 872246 | 44 | 49 |
| 872247 | 57 | 63 |
| 872248 | 24 | 44 |
| 872249 | 61 | 73 |
| 872250 | 34 | 28 |
| 872251 | 37 | 51 |
| 872252 | 54 | 62 |
| 872253 | 29 | 43 |
| 872254 | 94 | 71 |
| 872256 | 34 | 44 |
| 872257 | 70 | 72 |
| 872258 | 55 | 42 |
| 872259 | 82 | 72 |
| 872260 | 10 | 30 |
| 872261 | 37 | 55 |
| 872262 | 50 | 71 |
| 872263 | 28 | 49 |
| 872264 | 43 | 67 |
| 872265 | 36 | 35 |
| 872266 | 92 | 88 |
| 872267 | 68 | 74 |

TABLE 79

Reduction of human LRRK2 RNA in transgenic mice

| Compound Number | LRRK2 Expression (% control) Cortex | Spinal Cord |
|---|---|---|
| PBS | 100 | 100 |
| 802678 | 9 | 19 |
| 802780 | 42 | 49 |
| 802847 | 54 | 64 |
| 803021 | 67 | 70 |
| 803045 | 36 | 60 |
| 803064 | 42 | 67 |
| 803123 | 56 | 76 |
| 803181 | 41 | 74 |
| 803470 | 34 | 52 |
| 803503 | 67 | 72 |
| 803665 | 58 | 84 |
| 803769 | 71 | 90 |
| 872255 | 23 | 42 |
| 872268 | 52 | 66 |
| 872269 | 37 | 54 |
| 872270 | 39 | 61 |
| 872271 | 94 | 101 |
| 872272 | 76 | 77 |
| 872273 | 31 | 38 |
| 872274 | 54 | 85 |
| 872275 | 84 | 84 |
| 872276 | 73 | 97 |
| 872277 | 47 | 67 |
| 872278 | 36 | 68 |
| 872279 | 39 | 69 |
| 874144 | 81 | 86 |
| 874145 | 64 | 67 |
| 874146 | 67 | 64 |
| 874147 | 78 | 79 |
| 874148 | 57 | 58 |
| 874149 | 55 | 69 |
| 874150 | 57 | 44 |
| 874151 | 102 | 84 |

TABLE 80

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 30 | 41 |
| 803426 | 70 | 63 |
| 872280 | 83 | 64 |
| 872281 | 49 | 64 |
| 872282 | 48 | 64 |
| 872283 | 61 | 60 |
| 872285 | 26 | 41 |
| 876019 | 58 | 72 |
| 876097 | 47 | 46 |
| 876141 | 47 | 50 |
| 876168 | 103 | 89 |
| 876180 | 21 | 27 |
| 934558 | 54 | 49 |
| 934584 | 45 | 55 |
| 934585 | 162 | 95 |
| 934586 | 174 | 102 |
| 934587 | 35 | 238 |
| 934588 | 30 | 42 |
| 934589 | 19 | 30 |
| 934590 | 24 | 50 |
| 934591 | 42 | 52 |
| 934592 | 38 | 49 |
| 934593 | 31 | 35 |
| 934594 | 22 | 45 |
| 934595 | 59 | 61 |
| 934596 | n.d. | n.d. |
| 934597 | 48 | 59 |
| 934600 | 15 | 33 |

TABLE 81

Reduction of human LRRK2 RNA in transgenic mice

| Compound Number | LRRK2 Expression (% control) | |
|---|---|---|
| | Cortex | Spinal Cord |
| PBS | 100 | 100 |
| 780241 | 55 | 57 |
| 802678 | 12 | 20 |
| 876185 | 59 | 56 |
| 876190 | 25 | 38 |
| 876223 | 46 | 70 |
| 876326 | 36 | 57 |
| 876345 | 77 | 79 |
| 876735 | 64 | 57 |
| 876766 | 67 | 75 |
| 876900 | 41 | 46 |
| 877068 | 44 | 52 |
| 877159 | 52 | 61 |
| 877305 | 52 | 57 |
| 877328 | 68 | 76 |
| 890207 | 42 | 60 |
| 890208 | 32 | 45 |
| 890209 | 40 | 58 |
| 934599 | 29 | 37 |

TABLE 82

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 15 | 21 |
| 803427 | 34 | 32 |

TABLE 82-continued

Reduction of human LRRK2 RNA in transgenic mice

| Compound Number | LRRK2 Expression (% control) | |
|---|---|---|
| | Cortex | Spinal Cord |
| 876028 | 99 | 61 |
| 876029 | 106 | 69 |
| 876043 | 55 | 36 |
| 876062 | 39 | 26 |
| 876074 | 70 | 35 |
| 876146 | 82 | 42 |
| 876189 | 54 | 34 |
| 876203 | 90 | 46 |
| 876221 | 60 | 31 |
| 876237 | 80 | 35 |
| 876262 | 58 | 31 |
| 876284 | 74 | 41 |
| 876287 | 129 | 57 |
| 876302 | 81 | 34 |
| 876303 | 76 | 46 |
| 876899 | 60 | 34 |
| 876960 | 93 | 41 |
| 877119 | 62 | 36 |
| 877171 | 67 | 66 |
| 877292 | 68 | 58 |
| 877326 | 74 | 58 |
| 877349 | 106 | 81 |
| 877395 | 69 | 75 |

TABLE 83

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 13 | 13 |
| 876027 | 166 | 94 |
| 876031 | 23 | 18 |
| 876042 | 85 | 60 |
| 876068 | 80 | 54 |
| 876088 | 48 | 60 |
| 876143 | 79 | 70 |
| 876186 | 60 | 45 |
| 876195 | 54 | 48 |
| 876261 | 32 | 35 |
| 876263 | 46 | 42 |
| 876282 | 64 | 45 |
| 876285 | 89 | 59 |
| 876294 | 37 | 39 |
| 876301 | 51 | 55 |
| 876328 | 63 | 53 |
| 876604 | 26 | 22 |
| 876790 | 87 | 54 |
| 877098 | 65 | 41 |
| 877176 | 175 | 74 |

TABLE 84

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 31 | 40 |
| 872284 | 69 | 57 |
| 876274 | 65 | 60 |
| 877113 | 76 | 98 |
| 877303 | 67 | 68 |
| 890206 | 41 | 77 |

TABLE 84-continued

Reduction of human LRRK2 RNA in transgenic mice

| Compound Number | LRRK2 Expression (% control) Cortex | Spinal Cord |
|---|---|---|
| 934538 | 49 | 49 |
| 934540 | 80 | 67 |
| 934541 | 43 | 54 |
| 934542 | 44 | 63 |
| 934543 | 58 | 60 |
| 934544 | 46 | 52 |
| 934545 | 39 | 35 |
| 934546 | 37 | 44 |
| 934547 | 45 | 51 |
| 934548 | 37 | 43 |
| 934549 | 34 | 42 |
| 934552 | 37 | 35 |
| 934553 | 27 | 36 |
| 934554 | 23 | 36 |
| 934555 | 38 | 43 |
| 934556 | 10 | 17 |
| 934557 | 17 | 29 |
| 934558 | 46 | 51 |

TABLE 85

Reduction of human LRRK2 RNA in transgenic mice

| Compound Number | LRRK2 Expression (% control) Cortex | Spinal Cord |
|---|---|---|
| PBS | 100 | 100 |
| 802678 | 10 | 17 |
| 934514 | 17 | 28 |
| 934515 | 16 | 21 |
| 934516 | 9 | 26 |
| 934517 | 16 | 36 |
| 934518 | 25 | 23 |
| 934519 | 71 | 70 |
| 934520 | 47 | 27 |
| 934521 | 52 | 50 |
| 934522 | 45 | 58 |
| 934523 | 29 | 30 |
| 934524 | 35 | 38 |
| 934525 | 50 | 56 |
| 934526 | 41 | 43 |
| 934528 | 28 | 33 |
| 934529 | 30 | 33 |
| 934530 | 31 | 35 |
| 934531 | 33 | 37 |
| 934532 | 33 | 37 |
| 934533 | 37 | 32 |
| 934534 | 38 | 44 |
| 934535 | 80 | 55 |
| 934536 | 57 | 61 |
| 934537 | 45 | 45 |

TABLE 86

Reduction of human LRRK2 RNA in transgenic mice

| Compound Number | LRRK2 Expression (% control) Cortex | Spinal Cord |
|---|---|---|
| PBS | 100 | 100 |
| 802678 | 11 | 22 |
| 952334 | 43 | 27 |
| 952335 | 86 | 96 |
| 952336 | 34 | 53 |
| 952338 | 68 | 62 |
| 952340 | 36 | 36 |
| 953599 | 123 | 87 |

TABLE 86-continued

Reduction of human LRRK2 RNA in transgenic mice

| Compound Number | LRRK2 Expression (% control) Cortex | Spinal Cord |
|---|---|---|
| 953600 | 105 | 83 |
| 953601 | 103 | 87 |
| 953602 | 70 | 89 |
| 953603 | 48 | 74 |
| 953604 | 36 | 46 |
| 953605 | 69 | 51 |
| 953606 | 93 | 74 |
| 953607 | 53 | 65 |
| 953608 | 41 | 36 |
| 953609 | 84 | 69 |
| 953610 | 59 | 61 |
| 953611 | 42 | 61 |
| 953612 | 47 | 85 |
| 953613 | 81 | 74 |
| 953614 | 61 | 62 |
| 953615 | 41 | 42 |
| 953616 | 79 | 57 |
| 953617 | 107 | 67 |

TABLE 87

Reduction of human LRRK2 RNA in transgenic mice

| Compound Number | LRRK2 Expression (% control) Cortex | Spinal Cord |
|---|---|---|
| PBS | 100 | 100 |
| 802678 | 16 | 18 |
| 952358 | 80 | 84 |
| 952359 | 54 | 66 |
| 952360 | 34 | 39 |
| 952361 | 51 | 47 |
| 952362 | 42 | 41 |
| 952363 | 45 | 42 |
| 952364 | 45 | 57 |
| 952365 | 39 | 63 |
| 952366 | 38 | 56 |
| 952367 | 61 | 50 |
| 952368 | 33 | 52 |
| 952369 | 56 | 59 |
| 952370 | 37 | 62 |
| 952371 | 34 | 56 |
| 952372 | 27 | 65 |
| 952373 | 43 | 55 |
| 952374 | 58 | 72 |
| 952375 | 20 | 42 |
| 952376 | 29 | 41 |
| 952377 | 20 | 34 |
| 952378 | 28 | 41 |
| 952379 | 35 | 49 |
| 952380 | 22 | 51 |
| 952381 | 22 | 40 |

Example 14: Activity of Modified Oligonucleotides Complementary to Human LRRK2 in Transgenic Mice, Eight Week Assessment Modified oligonucleotides described above were tested in the human BAC wild type LRRK2 transgenic mouse model (described herein above) to assess activity after eight weeks. Mice hemizygous for the BAC LRRK2-Wt transgene are viable and fertile. These mice express a wild-type human leucine-rich repeat kinase 2 (LRRK2) gene directed by the human LRRK2 promoter/enhancer regions on the BAC transgene (Ouyang Y et al., 2011). Mice from this model express human LRRK2 in a variety of tissues, including the spinal cord and brain.

Treatment

LRRK2 transgenic mice each received a single ICV dose of 300 ng of modified oligonucleotides listed in the table below. Each treatment group consisted of 4 mice. A group of 4 mice received PBS as a negative control.

RNA Analysis

After eight weeks, mice were sacrificed and RNA was extracted from cortical brain tissue and spinal cord for real-time PCR analysis of measurement of RNA expression of LRRK2 using primer probe set hLRRK2 LTS35700 (described herein above in Example 11). Results are presented in the table below as percent LRRK2 RNA levels relative to relative to PBS control, normalized with cyclophilin A As shown in the table below, treatment with modified oligonucleotides resulted in reduction of human LRRK2 RNA in comparison to the PBS control.

TABLE 88

Reduction of human LRRK2 RNA in transgenic mice

| Compound Number | LRRK2 Expression in Cortex (% control) |
|---|---|
| PBS | 100 |
| 802665 | 44 |
| 934556 | 16 |
| 934517 | 26 |
| 802678 | 19 |
| 876031 | 33 |
| 934553 | 34 |
| 934554 | 34 |
| 780166 | 28 |
| 802714 | 27 |
| 802770 | 16 |
| 802938 | 23 |
| 803270 | 33 |
| 780161 | 39 |
| 780241 | 44 |
| 934557 | 18 |

TABLE 89

Reduction of human LRRK2 RNA in transgenic mice

| Compound Number | LRRK2 Expression in Cortex (% control) |
|---|---|
| PBS | 100 |
| 780164 | 54 |
| 803000 | 39 |
| 803268 | 66 |
| 876604 | 78 |
| 934518 | 21 |

Example 15: Activity of Modified Oligonucleotides Complementary to Human LRRK2 in Transgenic Rats Modified oligonucleotides described above were tested in the human BAC G2019S mutant LRRK2 transgenic rat (NTac:SD-Tg(LRRK*G2019S)571Cjli; Taconic) model to assess activity. The model was created through pronuclear injection of the entire human LRRK2 gene with the G2019S mutation into NTac:SD zygotes. Rats from this model express human LRRK2 in a variety of tissues, including the spinal cord and brain (West A B et al., *J. Comp. Neurology*, 2014, 522(11):2465-2480).

Treatment

LRRK2 transgenic rats each received a single ICV dose of 1,000 µg of modified oligonucleotides listed in the table below. Each treatment group consisted of 4-5 rats. A group of 4 rats received PBS as a negative control.

RNA Analysis

After two weeks, rats were sacrificed and RNA was extracted from brainstem, cortical brain tissue, spinal cord, lung and kidney for real-time PCR analysis of measurement of RNA expression of LRRK2 using primer probe set hLRRK2 LTS35700 (described herein above in Example 11). Results are presented in the table below as percent LRRK2 RNA levels relative to relative to PBS control, normalized with cyclophilin A As shown in the table below, treatment with modified oligonucleotides resulted in reduction of human LRRK2 RNA in comparison to the PBS control.

TABLE 90

Reduction of human LRRK2 RNA in transgenic rats

| Compound Number | LRRK2 Expression (% control) | | |
|---|---|---|---|
| | Brainstem | Cortex | Spinal Cord |
| PBS | 100 | 100 | 100 |
| 780241 | 60 | 42 | 54 |
| 802714 | 43 | 33 | 53 |
| 803268 | 66 | 58 | 73 |
| 876031 | 33 | 9 | 33 |
| 876604 | 38 | 19 | 39 |
| 934556 | 31 | 9 | 35 |

Example 16: Potency of Modified Oligonucleotides Complementary to Human LRRK2 in Transgenic Rats Modified oligonucleotides described above were tested in the human BAC G2019S mutant LRRK2 transgenic rat (NTac:SD-Tg(LRRK*G2019S)571Cjli) model, described herein above, to test the potency of oligonucleotides.

Treatment

LRRK2 transgenic rats each received a single intracerebroventricular (ICV) dose of 10, 30, 100, 300, 700, 1,000, or 3,000 µg of modified oligonucleotides listed in the table below. Each treatment group consisted of 5 rats. A group of 5 rats received PBS as a negative control for each dosage group.

RNA Analysis

After two weeks, rats were sacrificed and RNA was extracted from cortex for real-time PCR analysis of measurement of RNA expression of LRRK2 using primer probe set hLRRK2 LTS35700 (described herein above in Example 11). Results are presented in the table below as percent LRRK2 RNA levels relative to relative to PBS control, normalized with cyclophilin A.

As shown in the table below, treatment with modified oligonucleotides resulted in reduction of human LRRK2 RNA in comparison to the PBS control. Dose response data was analyzed using GraphPad Prism 6 software (San Diego, Calif.). $ED_{50}$ values were calculated from log transformed dose or concentrations and individual animal LRRK2 RNA levels using the built in GraphPad formula "log(agonist) vs. response—Find ECanything", with the following constraints: bottom >0, top=100, F=50 for $ED_{50}$

TABLE 91

Dose-dependent percent reduction of human LRRK2 RNA in transgenic rats, cortex

| Compound Number | LRRK2 expression (% control) in cortex | | | | | | $ED_{50}$ (µg/g) |
|---|---|---|---|---|---|---|---|
| | 10 µg | 30 µg | 100 µg | 300 µg | 1000 µg | 3000 µg | |
| 780241 | 107.4 | 96.4 | 75.9 | 41.9 | 33.1 | 34.9 | 129 |
| 876031 | 102.0 | 94.6 | 67.6 | 18.7 | 5.9 | 4.6 | 135 |
| 934556 | 105.9 | 94.2 | 56.6 | 17.3 | 7.1 | 3.7 | 111 |

Example 17: Tolerability of Modified Oligonucleotides Complementary to LRRK2 in Wild-Type Mice, 3 Hour FOB Assessment Modified oligonucleotides described above were tested in wild-type female C57/Bl6 mice to assess the tolerability of the oligonucleotides. Wild-type female C57/Bl6 mice each received a single ICV dose of 700 µg of modified oligonucleotide listed in the table below. Each treatment group consisted of 4 mice. A group of 4 mice received PBS as a negative control for each experiment (identified in separate tables below). At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the tables below.

TABLE 92

Tolerability scores in mice at 700 µg dose

| Compound Number | 3 hr FOB |
|---|---|
| PBS | 0 |
| 802678 | 0 |
| 693430 | 0 |
| 725607 | 0 |
| 780164 | 0 |
| 780166 | 6 |
| 780205 | 0 |
| 780254 | 7 |
| 780321 | 0 |
| 780685 | 2 |
| 802685 | 0 |
| 802688 | 0 |
| 802689 | 0 |
| 802731 | 6 |
| 802746 | 6 |
| 802888 | 6 |
| 802936 | 4 |
| 802937 | 4 |
| 802959 | 1 |
| 802962 | 0 |
| 802974 | 0 |
| 803002 | 7 |
| 803075 | 4 |
| 803682 | 1 |

TABLE 93

Tolerability scores in mice at 700 µg dose

| Compound Number | 3 hr FOB |
|---|---|
| PBS | 0 |
| 780160 | 0 |
| 802784 | 6 |
| 802939 | 3 |
| 803006 | 5 |
| 872248 | 7 |
| 872253 | 7 |
| 872260 | 7 |
| 872263 | 7 |
| 876190 | 2 |
| 934552 | 2 |
| 934553 | 0 |
| 934554 | 2 |
| 934555 | 2 |
| 934556 | 1 |
| 934557 | 1 |

TABLE 94

Tolerability scores in mice at 700 µg dose

| Compound Number | 3 hr FOB |
|---|---|
| PBS | 0 |
| 872255 | 5 |
| 934514 | 4 |
| 934515 | 2 |
| 934516 | 6 |
| 934518 | 4 |
| 934523 | 7 |
| 934528 | 5 |
| 934529 | 5 |
| 934530 | 3 |
| 934517 | 4 |
| 802758 | 7 |
| 876180 | 0 |

TABLE 95

Tolerability scores in mice at 700 µg dose

| Compound Number | 3 hr FOB |
|---|---|
| PBS | 0 |
| 780161 | 1 |
| 780164 | 5 |
| 780166 | 6 |
| 802665 | 1 |
| 802714 | 3 |
| 802770 | 4 |
| 802938 | 4 |
| 802963 | 0 |
| 803000 | 4 |
| 803268 | 4 |
| 803270 | 1 |

TABLE 96

Tolerability scores in mice at 700 µg dose

| Compound Number | 3 hr FOB |
|---|---|
| PBS | 0 |
| 876031 | 0 |
| 876604 | 5 |

TABLE 97

Tolerability scores in mice at 700 µg dose

| Compound Number | 3 hr FOB |
|---|---|
| PBS | 0 |
| 952334 | 2 |
| 952335 | 0 |
| 952336 | 2 |
| 952338 | 5 |
| 952340 | 3 |
| 952358 | 5 |
| 952359 | 7 |
| 952360 | 6 |
| 952361 | 4 |
| 952362 | 6 |
| 952363 | 3 |

TABLE 98

Tolerability scores in mice at 700 µg dose

| Compound Number | 3 hr FOB |
|---|---|
| PBS | 0 |
| 952364 | 0 |
| 952365 | 0 |
| 952366 | 3 |
| 952367 | 6 |
| 952368 | 5 |
| 952369 | 7 |
| 952370 | 7 |
| 952371 | 6 |
| 952372 | 7 |
| 952373 | 7 |
| 952374 | 4 |
| 952375 | 2 |
| 952376 | 5 |
| 952377 | 6 |
| 952378 | 3 |
| 952379 | 4 |
| 952380 | 7 |
| 952381 | 6 |
| 953599 | 0 |
| 953600 | 0 |
| 953601 | 0 |
| 953602 | 0 |
| 953603 | 0 |
| 953604 | 4 |
| 953605 | 5 |
| 953606 | 6 |
| 953607 | 3 |
| 953608 | 6 |
| 953609 | 6 |
| 953610 | 3 |
| 953611 | 3 |
| 953612 | 1 |
| 953613 | 0 |
| 953614 | 2 |
| 953615 | 4 |
| 953616 | 5 |
| 953617 | 5 |

Example 18: Tolerability of Modified Oligonucleotides Complementary to Human LRRK2 in Rats, 3 Hour FOB Assessment Modified oligonucleotides described abovere were tested in Sprague Dawley rats to assess the tolerability of the oligonucleotides. Sprague Dawley rats each received a single intrathecal (IT) dose of 3 mg of oligonucleotide listed in the table below. Each treatment group consisted of 3-4 rats. A group of 4 rats received PBS as a negative control for each experiment (identified in separate tables below). At 3 hours post-injection, movement of 7 different parts of the body was evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was not moving. For each of the 7 criteria, a rat was given a subscore of 0 if it met the criteria and 1 if it did not (the functional observational battery score or FOB). After all 7 criteria were evaluated, the scores were summed for each rat and averaged within each treatment group. The results are presented in the tables below.

TABLE 99

Tolerability scores in rats at 3 mg dose

| Compound Number | 3 hr FOB |
|---|---|
| PBS | n.d. |
| 780164 | 2 |
| 780166 | 2 |
| 780189 | 1 |
| 780236 | 4 |
| 780241 | 1 |
| 780243 | 3 |
| 780254 | 3 |
| 780347 | 0 |
| 780549 | 0 |

TABLE 100

Tolerability scores in rats at 3 mg dose

| Compound Number | 3 hr FOB |
|---|---|
| PBS | 0.25 |
| 780236 | 5 |
| 802678 | 2 |
| 802688 | 2 |
| 802748 | 6 |
| 872259 | 3 |
| 872261 | 4 |
| 872269 | 4 |
| 872279 | 3 |

TABLE 101

Tolerability scores in rats at 3 mg dose

| Compound Number | 3 hr FOB |
|---|---|
| PBS | 0 |
| 725607 | 1 |
| 780620 | 6 |
| 802888 | 5 |
| 802936 | 5 |
| 802937 | 5 |
| 802959 | 4 |
| 802961 | 2 |
| 802962 | 2 |
| 802974 | 3 |
| 803520 | 5 |

TABLE 102

Tolerability scores in rats at 3 mg dose

| Compound Number | 3 hr FOB |
|---|---|
| PBS | 0 |
| 725609 | 0 |
| 780164 | 3 |
| 780166 | 6 |
| 780205 | 3 |
| 802689 | 2 |
| 802731 | 7 |
| 802746 | 5 |
| 802845 | 2 |
| 802846 | 4 |
| 876088 | 1 |

TABLE 103

Tolerability scores in rats at 3 mg dose

| Compound Number | 3 hr FOB |
|---|---|
| PBS | 0 |
| 802655 | 5 |
| 802686 | 2 |
| 802688 | 2 |
| 803075 | 5 |
| 803682 | 1 |
| 876031 | 0 |
| 876261 | 4 |
| 876263 | 2 |
| 876294 | 2 |

TABLE 104

Tolerability scores in rats at 3 mg dose

| Compound Number | 3 hr FOB |
|---|---|
| PBS | 0 |
| 693430 | 3 |
| 780219 | 5 |
| 780254 | 2 |
| 780321 | 3 |
| 780347 | 1 |

TABLE 105

Tolerability scoes in rats at 3 mg dose

| Compound Number | 3 hr FOB |
|---|---|
| PBS | 0 |
| 780160 | 1 |
| 780161 | 2 |
| 802784 | 5 |
| 802938 | 1 |
| 802939 | 3 |
| 802963 | 2 |
| 803000 | 5 |
| 803006 | 4 |
| 803270 | 1 |
| 872248 | 3 |
| 872253 | 6 |

TABLE 106

Tolerability scores in rats at 3 mg dose

| Compound Number | 3 hr FOB |
|---|---|
| PBS | 0 |
| 872260 | 5 |
| 872263 | 7 |
| 934553 | 0 |
| 934554 | 0 |
| 934555 | 2 |
| 934556 | 0 |
| 934557 | 0 |

TABLE 107

Tolerability scores in rats at 3 mg dose

| Compound Number | 3 hr FOB |
|---|---|
| PBS | 0 |
| 934517 | 2 |
| 934523 | 6 |
| 934528 | 4 |
| 934529 | 1 |
| 934530 | 0 |

TABLE 108

Tolerability scores in rats at 3 mg dose

| Compound Number | 3 hr FOB |
|---|---|
| PBS | 0 |
| 802678 | 0.5 |
| 802758 | 3.25 |
| 876604 | 5 |

TABLE 109

Tolerability scores in rats at 3 mg dose

| Compound Number | 3 hr FOB |
|---|---|
| PBS | 0 |
| 802665 | 1 |
| 802714 | 2 |
| 802770 | 2 |
| 803268 | 3 |
| 872255 | 5 |
| 934516 | 3 |
| 934518 | 4 |

TABLE 110

Tolerability scores in rats at 3 mg dose

| Compound Number | 3 hr FOB |
|---|---|
| PBS | 0 |
| 693421 | 2.5 |
| 690093 | 3.0 |

TABLE 111

Tolerability scores in rats at 3 mg dose

| Compound Number | 3 hr FOB |
|---|---|
| PBS | 0 |
| 952334 | 4 |
| 952335 | 2 |
| 952336 | 3 |
| 952338 | 2 |
| 952358 | 3 |
| 952359 | 2 |

TABLE 112

Tolerability scores in rats at 3 mg dose

| Compound Number | 3 hr FOB |
|---|---|
| PBS | 0 |
| 952378 | 5 |
| 952379 | 5 |
| 952380 | 3 |
| 952381 | 4 |
| 953599 | 1 |
| 953600 | 1 |
| 953601 | 0 |
| 953602 | 2 |
| 953603 | 0 |
| 953604 | 3 |
| 953605 | 5 |
| 953606 | 5 |

TABLE 113

Tolerability scores in rats at 3 mg dose

| Compound Number | 3 hr FOB |
|---|---|
| PBS | 0 |
| 953607 | 3 |
| 953608 | 4 |
| 953609 | 5 |
| 953610 | 3 |
| 953611 | 4 |
| 953612 | 3 |
| 953613 | 1 |
| 953614 | 4 |
| 953615 | 1 |
| 953616 | 4 |
| 953617 | 4 |

TABLE 114

Tolerability scores in rats at 3 mg dose

| Compound Number | 3 hr FOB |
|---|---|
| PBS | 0 |
| 952371 | 4 |
| 952372 | 4 |
| 952373 | 4 |
| 952374 | 2 |
| 952375 | 5 |
| 952376 | 4 |
| 952377 | 5 |

TABLE 115

Tolerability scores in rats at 3 mg dose

| Compound Number | 3 hr FOB |
|---|---|
| PBS | 0 |
| 952340 | 1 |
| 952360 | 4 |
| 952361 | 3 |
| 952362 | 5 |
| 952363 | 4 |
| 952364 | 5 |
| 952365 | 2 |
| 952366 | 5 |
| 952367 | 5 |
| 952368 | 6 |
| 952369 | 4 |
| 952370 | 5 |

Example 19: Prophylactic Reduction of LRRK2 with Modified Oligonucleotides in PFF Model Wild type mice received a single ICV injection of 700 μg of an oligonucleotide listed in the table below or PBS vehicle alone. Each treatment group consisted of eleven or twelve mice. Two weeks after oligonucleotide treatment, preformed fibrils (PFFs) of α-synuclein were injected into the striatum, resulting in formation of α-synuclein aggregates in several brain regions and motor deficits, as described (see Luk et al., *Science*, 2012, 338, 949-953). One control group did not receive injection of PFFs. Fifty-five days after the oligonucleotide treatment, motor function was tested in a wire hang test. The results are presented in the table below as the average length of time the mice of each treatment group remained on the wire.

One day after the wire hang test, all of the mice in each treatment group were sacrificed except for the group that received no oligonucleotide and no PFF injection; only four mice in that group were sacrificed Animals were perfused with ice-cold PBS. Ipsilateral hemispheres were fixed and processed for immunochemistry. Contralateral midbrain and striatum were dissected and frozen until RNA analysis, while entire contralateral cortex was dissected and frozen until protein analysis. LRRK2 RNA expression was analyzed by quantitative real-time PCR using the murine primer probe set RTS3043 (forward sequence GGCGAGTTATCCGCACCAT, designated herein as SEQ ID NO: 23; reverse sequence CCAAAACCAGCATGACATTCTTAA, designated herein as SEQ ID NO: 24; probe sequence TGAGAGCCATGGCCACAGCACAA, designated herein as SEQ ID NO: 25). LRRK2 RNA levels were adjusted according to total RNA content, as measured by RIBOGREEN. The results are shown in the table below as average percent inhibition relative to the wild type control group that received neither oligonucleotide treatment nor PFF injection.

LRRK2, α-synuclein, and hyperphosphorylated α-synuclein (p-α-syn) protein levels in the cortex were analyzed by western blot. Contralateral cortex tissue was first homogenized in RIPA buffer and centrifuged at 13,300×g. The supernatant was subjected to western blot for LRRK2 protein level, and β-tubulin was used as a loading control. The results indicated that LRRK2 protein levels in the cortex were significantly lower in the oligonucleotide treated animals than in the animals that did not receive oligonucleotide treatment. The pellet was resuspended in RIPA buffer, centrifuged at 100,000×g, and the resulting insoluble material was further suspended in 2% SDS buffer, followed by an additional 100,000×g spin. The resulting supernatant was analyzed by western blot for α-synuclein and p-α-syn. The results showed that PFF injection resulted in recruitment of endogenous mouse α-synuclein into insoluble aggregates, as reported in Luk et al. The aggregates were also hyperphosphorylated. Oligonucleotide treatments reduced formation of the aggregates, as evidenced by a reduction of insoluble mouse α-synuclein and p-α-syn in the western blots. p-α-syn aggregates in the substantia nigra were visualized by immunohistochemistry. The average number of aggregates observed for samples of equal size from each treatment group is shown in the table below. One-way ANOVA test of the results showed that the differences between the PBS treated and oligonucleotide treated animals were significant.

TABLE 116

Prophylactic treatment of PFF mice with LRKK2 modified oligonucleotides

| Compound Number | PFF injected | Time in wirehang test (sec) | Inhibition of LRRK2 RNA (%) | | No. of p-α-syn aggregates |
|---|---|---|---|---|---|
| | | | Midbrain | Striatum | |
| PBS | No | 193 | 0 | 4.0 | 0 |
| PBS | Yes | 94 | 0 | 0 | 42 |
| 693421 | Yes | 187 | 52.0 | 49.0 | 12 |
| 690093 | Yes | 175 | 43.0 | 24.8 | 21 |

Example 20: Reduction of LRRK2 with Modified Oligonucleotide in PFF Model

The effects of oligonucleotide reduction in wild type mice after the injection of PFFs was evaluated using 690093. Mice were treated as described in Example 19 except that oligonucleotide treatment occurred two weeks after PFF injection instead of two weeks before PFF injection. Each treatment group consisted of ten animals Fifty-five days after PFF injection, the mice were assessed in a wire hang test, as described in Example 19. One day after the wire hang test, the mice were sacrificed, the midbrain, striatum, and substantia nigra were collected, and LRRK2 RNA and p-α-syn aggregates were measured, as described in Example 19. The results are shown in the table below as the averages for each treatment group. An entry of "nd" indicates that data was not collected for that treatment group. The results show that even when the modified oligonucleotide was administered after the onset of the PFF model, motor function was improved and the number of pathological aggregates was reduced.

TABLE 117

Treatment of PFF mice with LRKK2 modified oligonucleotides

| Oligo ID | PFF injected | Time in wirehang test (sec) | Inhibition of LRRK2 RNA (%) | | No. of p-α-syn aggregates |
|---|---|---|---|---|---|
| | | | Midbrain | Striatum | |
| PBS | No | 227 | 0 | 0 | nd |
| PBS | Yes | 58 | 0 | 0 | 49 |
| 690093 | Yes | 141 | 62.3 | 43.6 | 38 |

Example 21: Prophylactic Reduction of LRRK2 with Modified Oligonucleotides in PFF Model in a Long Term Study Modified oligonucleotides were tested in a long term study to determine if long term treatment with modified oligonucleotides is protective of dopaminergic neurons. Accumulation of α-syn aggregates in the substantia nigra pars compacta compromises survival of dopaminergic neurons over time (Luk 2012, Tran 2014).

The effects of oligonucleotide reduction in wild type mice after the injection of PFFs was evaluated using 690093 or control oligonucleotide 676630, a 5-10-5 MOE gapmer with mixed phosphodiester and phosphorothioate backbone with no known target. Mice were treated as described in Example 19 except mice received a second ICV dose of 690093 at 90 days, and were sacrificed at 180 days post first ICV treatment. Each treatment group consisted of 12 animals. At sacrifice, midbrain, striatum, and substantia nigra were collected, and LRRK2 RNA and p-α-syn aggregates were measured, as described in Example 19, and dopaminergic cells were quantified by immunohistochemistry using anti-tyrosine hydroxylase (TH) antibody. The results are shown in the table below as the averages for each treatment group. The results show that in the group treated with modified oligonucleotide complementary to LRRK2, the number of pathological aggregates was reduced over a long treatment course. Additionally, quantification of TH-positive neurons showed that 690093-mediated LRRK2 suppression rescued TH-positive cells in the ipsilateral substantia nigra pars compacta as compared to control treated cells.

TABLE 118

Prophylactic treatment of PFF mice with LRKK2 modified oligonucleotides in long term study

| Compound Number | PFF injected | Inhibition of LRRK2 RNA (%) Midbrain | Striatum | No. of p-α-syn aggregates | No. of dopaminergic cells |
|---|---|---|---|---|---|
| 676630 | Yes | 0 | 0 | 160 | 5880 |
| 690093 | Yes | 61.7 | 0 | 48 | 7522 |

Example 22: Tolerability of Modified Oligonucleotides Complementary to Human LRRK2 in Rats, Long-Term Assessment In separate studies run under the same conditions, modified oligonucleotides described above were tested in Sprague Dawley rats to assess the long-term tolerability of the oligonucleotides. Sprague Dawley rats each received a single intrathecal (IT) delivered dose of 3 mg of oligonucleotide or PBS. For 6 weeks beginning 1 week post-treatment, each animal was weighed and evaluated weekly by a trained observer for adverse events. Adverse events were defined as neurological dysfunction not typical in PBS-treated control animals, including, but not limited to: abnormal limb splay, abnormal gait, tremors, abnormal respiration, paralysis, and spasticity. The onset of the adverse event is defined as the week post-dosing when the dysfunction was first recorded. If no adverse event was achieved, there is no onset (–). The onset of adverse events typically correlates with a failure to thrive as defined by a lack of body weight gain/maintenance similar to PBS-treated animals Similar tolerability assessments were described in Ostergaard et al., Nucleic Acids Res. 2013 November; 41(21): 9634-9650 and Southwell et al., Mol Ther. 2014 December; 22(12): 2093-2106. As shown in the table below, 876031, 780241, 802714, 803268, 876604, and 934556 were well-tolerated in the long-term tolerability assessment.

TABLE 119

Long-term tolerability in rats at 3 mg dose

| Compound Number | Adverse event onset, weeks post-treatment, individual animals |
|---|---|
| 690093 | 2, 3, 4, 4 |
| 693421 | 4, —, —, — |
| 876031 | —, —, —, — |
| 780241 | —, —, —, — |
| 802714 | —, —, —, — |
| 803268 | —, —, —, — |
| 876604 | —, —, —, — |
| 934556 | —, —, —, — |
| PBS | —, —, —, — |

SEQUENCE LISTING (3848 sequences)

SEQ ID NO: 1 - DNA, 9239 bp, Homo sapiens
gcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcacgcctccaagttatttcaaggcaaaaatatccatgtgcctctgttgatcgtcttggactcctatatgagagtcgcgagtgtgcagcaggtgggttggtcacttctgtgcaaattaatagaagtctgtccaggtacaatgcaaagcttaatgggaccccaggatgttggaaatgattgggaagtccttggtgttcaccaattgattcttaaaatgctaacagttcataatgccagtgtaaacttgtcagtgattggactgaagaccttagatctcctcctaacttcaggtaaaatcaccttgctgatattggatgaagaaagtgatattttcatgttaatttttgatgccatgcactcatttccagccaatgatgaagtccagaaacttggatgcaaagctttacatgtgctgtttgagagagtctcagaggagcaactgactgaatttgttgagaacaaagattatatgatattgttaagtgcgttaacaaattttaaagatgaagaggaaattgtgcttcatgtgctgcattgtttacattccctagcgattccttgcaataatgtggaagtcctcatgagtggcaatgtcaggtgttataatattgtggtggaagctatgaaagcattccctatgagtgaaagaattcaagaagtgagttgctgtttgctccataggcttacattaggtaattttttcaatatcctggtattaaacgaagtccatgagtttgtggtgaaagctgtgcagcagtacccagagaatgcagcattgcagatctcagcgctcagctgtttggccctcctcactgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggaggccgcatgctgggcactaaataatctccttatgtaccaaaacagtttacatgagaagattggagatgaagatggccatttcccagctcatagggaagtgatgctctccatgctgatgcattcttcatcaaaggaagttttccaggcatctgcgaatgcattgtcaactctcttagaacaaaatgttaatttcagaaaaatactgttatcaaaaggaatacacctgaatgttttggagttaatgcagaagcatatacattctcctgaagtggctgaaagtggctgtaaaatgctaaatcatctttttgaaggaagcaacacttccctggatataatggcagcagtggtccccaaaatactaacagttatgaaacgtcatgagacatcattaccagtgcagctggaggcgcttcgagctattttacattttatagtgcctggcatgccagaagaatccagggaggatacagaatttcatcataagctaaatatggttaaaaaacagtgtttcaagaatgatattcacaaactggtcctagcagctttgaacaggttcattggaaatcctgggattcagaaatgtggattaaaagtaatttcttctattgtacattttcctgatgcattagagatgttatccctggaaggtgctatggattcagtgcttcacacactgcagatgtatccagatgaccaagaaattcagtgtctgggtttaagtcttataggatacttgattacaaagaagaatgtgttcataggaactggacatctgctggcaaaaattctggtttccagcttataccgatttaaggatgttgctgaaatacagactaaaggatttcagacaatcttagcaatcctcaaattgtcagcatctttttctaagctgctggtgcatcattcatttgacttagtaatattccatcaaatgtcttccaatatcatggaacaaaaggatcaacagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaaatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggaagtgaaggctcatttcttgtgaaaaagaaatctaattcaattagtgtaggagaattttaccgagatgccgtattacagcgttgctcaccaaatttgcaaagacattccaattccttggggcccatttttgatcatgaagatttactgaagcgaaaaagaaaaatattatcttcagatgattcactcaggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaaactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtcgtgaggaattctatagtactcatccccattttatgacgcagcgagcattgtaccttgctgtctatgacctcagcaagggacaggctgaagttgatgccatgaagccttggctcttcaatataaaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctttgtaaaatcatggcacagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtgatggcagttttggatcagtttaccgagcagcctatgaaggagaagaagtggctgtgaagatttttaataaacatacatcactcaggctgttaagacaagagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctgatccagttaaagaatatggttgtgccccatggcctatggttgagaaattaattaaacagtgtttgaaagaaaatcctcaagaaaggcctacttctgcccaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaaggtacacaaaagcagaaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaaaaaaaaaaaaaaaaa

SEQ ID NO: 2 - DNA, 150001 bp, Homo sapiens
gtactttttccttcttcagaaattgatagagaaaggctactacatactctgaatggatgtcaattggacatccaaaaggacaagatggcaattctcccatcttgtccttcttcaaaagtgtctagtctatactaggccttttgatcttgctgaaatctatgtaaatcttgttgagaatttcactaatcttgcattgttttttattactttgtagagaattgacatatttttgaatttagttttcccattaattaatgtgatattaatatttattcatgcctttttaatgccttttaacagagttcaataatttattcataaaggttttgtaaatatttgttaatttattttcaaggtttccctttcattgtcatcatacacacacacacacacaattgcactttatgcttgtgcatcactcatgtttaggaacacattttttttataatgatgacattaaaaaatacttattggtcattcaaaatgaatttccttttcaaaaccttagtttattattttttttcctggtctatctgtggcgtaataccctcctcccagtgatttgtaagaacttttgaaagttgaaggcaaattgtatttcatcatatgtatttcaaattttttcttcctgtttgccgtttgacttctagtttcattattgggtattttttctttgactgcagaaaatttaaatttgatggagtcacatatactacccttatgtgatttcttttttgtttttatgtttcctttttcaagattatataactattaatttatattttatttttgaagttatttttatttaactttttaatctatttgatgtttgctgtaattagtaatgtcagttttattttttttcttttcaggaaattagccaaatgttctagcaccattttattctccactgaaccctgcttccatcataaattcatgccttaatcttcattttcagtcttgttaactacttgaagagttgataaatcttggaatttcagtcaatcaattaaacatttttgaaaactaagagaatactttaccttaacactgcagtagttcatgggagaatgctcccaacaaataattcatattttcacactgtctactcacagtctggccaatatagagtagataataaataggcaatagatggatgaatgaattgtggaaattaggagacatcttttaatttagatttatttttctttggaagggaggtaggttttaatttcttgcaaggttgtaattcagtagaacaggaagggagaaactaatgcagaggaacagaaggaatgcatgagatggagaatgcctagaaatgtttgagacattgattaagtcatcagaaatggaaacaagtttagaaacaacttagaaaataatacactgtaggtctgataaatattgtaagattgggagttttttgttaaattatggaaaattttatatagatacaatagtagaacagaccacatgaacccatctcatattatcttcaacaattatcaattcaaaagttgttatcgttatctctatctccacacatttcatcttttcctccaccactggatgactttgaaagaaatcctaaccatttcaactataaatattttagcatgtctctgtaaaagttaaagactctataacaacaagacatagacccaatatccaggttgagtaggagtttgctatcttactaatctaatgtattaacaaagtctagagcattcttattaaagtggtagagcatgaagaaccttctacctggagttaggagatttgctgggttgaagtcctggctctcaacttcccacctgtgtgactccagcaaagctcttcacttctcaattccaaatctcaatttcctcactagtgaaagaaggatacatagtagtagttgtatccatttcagaattgtcatcaggattgaagtaacagatgtgaaaacaaaactaaaattgtgaagtagtaacttccagtccaatcctcttctttgtaagtgatcttgaggacagacacatcacctgaaggatagatcatctttgcctagccttgtctacaatgttcttgctaggtttcttttcctaaaaacacattacttaggtacttaacagaacaaacaaacaaacaatcaaaagacaaaaccaaaaaactttggggttatagacacccatactcataagtatttctgaataccaagagaagagtatttaggtttgcttctctcaacttttcacctttcatttcatgtaccctgtcctttgtctcagctctaatagctctgagagctgattacttttcgggtgtcccaagtatcaggatcctgcctagtgcaactcaaatttccaaaagttaatttagtggccttttggtgaccagagcttcagataactcacagggaaacaatgtttatttcctctcccactaacagtcacaaaaaatcataaaaaagagtagcgggggcagttttgatggctaacccctctttccatcctttgggggaaaattgctcatctccctataggtggaactctaaagacaatgtattcctaaaaggggccatctgggcggtgtcctcttttcccagcgccctgatttctattcttagatctggagataggcggctttcatttttcctgctcccagttcccagaccttccgtggggccgcaggatccccggctggcgggtcgcggagggtggccggccgggctgcgcactgcgcgcctccgctgcggggctccgggcctgtggactcagcggagtccgctgagtcagtttcttcccgcgcgactcccggccgcgccgccgctgcggtggaatctggtcccaggaggcggcgtccgcccggggtccggtctaggcgtgcgtgggggccacggtcacggtcatcccagccaggcccggctccagcagccccacggccgccgccagagttctgcgcggcccgtcgcctcggcggagcctctggcaggcccctgagctcgtttttggggcctgagtgggggaggaggaagccgagcaggagggctccggagagggagggcaacgcggggcggggagctgcctccttcctcataaacaggcgggcgtgggcgccgatggggcccgcggggagcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcggtaatcacttgaaaataaactgtgcttttatttttgcaaactttctccccctccttacatttgcaaattttgtcctcctccccttgaccctgctcaaacccggactcttaaggagccgcaaactcccatatcctttccttagggcagaaagcagctgagaatttcaggaaggtcttcacctttttgacttttctccccgtttcagactaaaaaggagagggggtgctgtggattgtgactttgcttcttttccccacccacttgttttccagcctccaagttatttcaaggcaaaaatatccatgtgcctctgttgatcgtcttggactcctatatgagagtcgcgagtgtgcagcaggtaaaggcattgttttcacttcaactcattctcccttctgtttggaaggagacgttttactggcaatgttaatatagccgagagttcttggttattcccaaaatttggcttgaggaacctctgactgtgattttaagatgggaatattgttaaatcattacgcaatgtaaacgggatgaagagccccagtatgtgttccctgagtgtctttaagaagtaactttataaaaccaacagtatggatggtggtagaaggaggataaaaatgggttcggttttagtctcgttattggcaagatgaattcattagtgtttagacttgactattccaagtatcttcccaatacagagcatgtcctagatgagaagattatgaatagtttggaaaaggggaataattaatagtgataaaatgcaactttgtcactagcaaactcttgtagagttcagcactttttaaaattcaaagatttctagcctttagttgtagtataccttgtagtatctaaagaaagtgatgtcttatgagaccctcatagtttgcaactgttgtcatataaaatgcatgtagaagtgaaacttttacaatctgtaccataggaaacccagaaatttgctatgtatcttggatttttttttaaagggggccttaaaaatggtaattaagaatgatttacagtcaaaacaaaattataggccaaggtgataacttccttcggagcacttagagatttggggaactgaaatcagttttgtcatctgcatgttaactcatgcagagaaagagaattggactttgaactccttggaggtgcagtcagaaagccaatgtttcttaatggttgagaggcttgacagacatgaggcatctcaatctttaaagtggtgtgggtctatctttatcttgatgtttatctctgtatctagctgtatctagtctgggtgaaccatctagcttctttgatatgaggacatttacatctggaagaaatattttaatttgttttcaactgtgaaatattttccatctgactattatagattttcacgctgctatcaaaccaaaccaagaaaagatggaggcataataaagatgctgttcttttaagactcaaagtcggaattttgcctgtggaatatgagtcactttttgggcactggcctattgtgcttcctgctctgcacccacgtcatcccttcttacttgtctctgctttggtgttcagaagtgcctgattctggccaccttcattccctagactctgtacttgatagagtcactcctgcttgatactgctcaggacagtcagatcctgggtaggcgttttggtctgcagggtctagataaggcagtgctatacttgacaacccaggggagcctggaacatacttcctaattcttaattttagaaattgcccaagcctgagcatacttgtccggagtagttatgagtgtcacttagtatttctgcctagagagtaccagaggcaaagtatgctggaaaataaggaagagtttttttaaaagtaattaattacttttttggatatatcatagttgtatatattttggggatacatatgctatttgatacatgtatacaatgtgtaatgttcaaatcagggtaactggaatatccgtcacctcgaacatttttctttgtgttggcaacgttgcaatttctttcttctagctattttaaaatatgcaatgaattattaaccataatttccctgctatactattaaatattaacttaattgcttgtatctaattatatttttgtacacattaaccaccttctctttatccctccccatcctttcatttccagtctctggtaaccaccattctactctcttcctccatgagatccaccttttccgctcctacatatgagtgagattatgcaatattttatttctgtacctggcttatttaatttaacctaatgacctccagtcccacccatgctgttgcaaatgacaggatttcattttttatgactgaataatattccattgtgtatgtataccacattttcttttatttttagttaagtaattaatttagagacagggtctcactctgttgcccagactggagagcagtggtgtgatcaaagctcactgcaggcctgcaatcctgggctgaagtagtcctcctgcctcagcctcccaggtagctaggactataagcatgtgccaccatgctcagctaatttttttttctttttttactttttgtagagatggagtcttgctatgttgcccaggttagtttcaaactcctgacctcaagtaatcctcctgcctcggcctccatattttctttgttaatctgttgatagacatataaggtgattctgtattttaactattgtgaacagggctgcaataaacatgggagttcagatatatctttgatatactgatgttctttttttggatatatacccagcgatgagattactggatcatatgaaaattctctttttagttttttaagatacctccatactgtgtttcatcatggctgtgctactttatattcccatcagcagtgtaccaccattcccctttttctgcatccttaccagcatttgttattttttgtctttttgataatagccattctgcctgtggtgagataatatctcattatggttttgatttgcctctccctaatgattagtgaagtttaggatttttttttcatgtacctgttagccatttgtctgtcttcttttgagaaatgtctatttggatcttttgtccatttaaaaataagacttttttttttttttttttttttgctaattgagtttttttagttccttatgtattctggttgttaatcttttgttgaatggatattttgcaaatattttctccctttctttatgttgtctcttcactttgttaattattttctttgttgtgcagaagctttttagcttgatataatcccatttgcctatttttgttgtaattgcctgtgcttttgaggtcctaccccaaaaatcattgcacagaccaatgtcctgtagcatttccccagtgttttcttctagtagttgcatattttcaggtctgagatgtaagtctttaatccattttgaaatgatttgtgtatatggtgaaagctgtggatctagtttccttcttttgcacagccaatatttgattctcactgaaatctcactgccctcctggaaatattaccggatgttttactgtcatagcgaagtgagagtaagctgctcactgaggatcaaagagcttgtgacagacctaagactcaagtcttctcacaccttcaaaatctctttccatcatacaatctactagctgctgaattcgcaagctttttgtgcaagctagtaaaaagcaaaatggtttgatacaaatactgtggccatgctaggtacaatgacatcaatttaaattatcattggtcttaacaaggggatgtagaaaggggtctcctactgacattttaatactcacttaaaagtagtatttttccttcagatttctttatattattagtataattactgtaagtatcctttactgctttatatgttgaattagctggaagtgccaaaagaaaaactcttaatgataaatttaaggtattaaggtaaatttctccttcatttaatttaatagtaattcttaattactatttaaaataaagattaaggtttgtttctagatgccatttaacatgatattccagactgccagttttattttcaaagtttgtttcatattttattaatgtttcttcataaatgacagtctttagaaaattgacggttaagctaggtgctttatatttttcttttcctgcctatcttttcactgtgctcctaaattttacatctctttattctcaagggttcaacctttgaagaaggggagcaaaataaatgaaagtggctaaaattttttctttaacccctagactctttcctgttgtgcattaattacatgcttgagtttttagaataattataataaagtaaaactaccaatttaattgtattgtaactgtgcaagatgggaaccttctctcttagagagataagcttttaattgaatagattaatggatcaattgttacctctgctttgctgccagagattctatttaatcacagaagttccatgtagtgctggagagctcagttgcctgaatctttttgcaaagcgtttactgatactgttgcttcaccaaccaaaacaaacaggttttttccttgagtcagctttgtaggtacagagatgagtttggcatcctatgtgacttttttttttttttttttttttttttttaccaccagaagctgttcagaatgttattttcttaaatagttcggaaaaaagtcttgatgtattctatgaaagcacaaaaatagtcagtttctatgacagctggattgtcaacgtctgttcagcttacgtggaggaggatgtcctacttgagtagtataggtagaaatagctatcagaaattgccgcctttgaaagcaatttgaaattatgtaaaaggaagtaatgacaaaataaagcaatttatgtttaatctggaaaagatccaaaagtaatattgtaaagagatcttgagtaatcatttttatcttcctaaaatagccgttgtttactcccgtaagcgagtaagaaacttgtgccattattccttattgggtgcatatagatttctcaccttgtcattcaactccttgcaatattcaactttacttatgcatccagccttatcccaaaatagcctcttccctgtagcagcttccttatcatgtagcagcctactctcctcaccgctcatccgttcttatacaatctggcttaagctctacctcttcatattatattcttctctgagtaatttcaactcacactgagtcttactttcagtatttctattatattggtatttattacacatcacacttagatacttttccattagtctctagagggtacatatatgcactttctctttttttttttttttttgaccatgtcaagtatagttctatagtataatagaatgaattggagatcctttacatttagagagggaggagtctacagtaggaagaataggttaattttcatctccggtttgaaatcaggactttcaatttttttttcagaggtaaagagcaacttagtcaagttggcatcttgtaaacagactgagtgaagatatacttaaaatgcatctataatttcatattttatttcgaaatgtgaaagagcctactaggggtgtctgtgatctctagaccttatcaattcattctagagaaatctggagggagccattgaggagttctacctcctgtctattttatagagctctttctctttttctcctatcagatgtagattcaattgctaaaaatgccacgtttcttgcctctattattctagcttcattacttggggagcagccattctgataacttacattttgctactaaaatctccaacttcacctaatccttcattataagccacttcattttttcctataattaaaattttaaatatgtggaggaaattctgtcaggtagatatgacttaaaacctactaagggccaggtgcagaggctcacgcctgtaatcccagcactttgagaggccaagtcaggaggattgcttgagcccaggagcttgagaccagcctgggcaacagagcgagacccctgtcttcacaaaaaaaaaaaaaaaaaaattagctgggtgtggtggcacatacctgtagtcccagctacttgggaggctgaagtgggtggatcacctaaggacaggagttctaggctgcagtgatctatgattgcaccattgcactccagcctgggtgacagagtgagaccctatctcaaaaacaaaaacaaaaccaaaaaaaaaaaaaaaacaagaaaaaaaaagtactaaggatctggtatagccattcttgcacttaataatcttggtacaacctctaaaactattttttatagtttattttattttgccttatttagacaattggcatgtctatgttcttcataatttagaaattatatgtatttatatatataaattatatatattatatattatgtataaattaaattatatatatatataatatatatatatttgaaatggattcttgctctgtcatccaggctagagtgcagtggcacaatcttggctcactgcaccctctgcctcctgggttcaagcgattctccttcctcagcctcccgagtagctgagattacaggcgcccatcaccatgcctggctaatttttgtatttttagtagagactgggtttcaccatcttggccacattggtctcaaactgccggctgaaatgttgtattttttgtatgtctttctggtatgatttttggagaaaggtgtatcctaagaatacggcttgcttttgtttctgggtaagcattttagggtatcattttgttgtataaccattgtttacaagtgagataagcatctattccactaagattgaagagattcatgtttgactgagtatgctctattaacattctttaaaacatgtgaatatatgtctttcttgttttcaggtgggttggtcacttctgtgcaaattaatagaagtctgtccaggtacaatgcaaagcttaatgggaccccaggatgttggaaatgattgggaagtccttggtgttcaccagtaagtatgatagatatgtaaaacaaatggccttgagtatttatttgtacacatgacaaccttcccttgatacactgtgtttgcaatccaaggctactcctgtggaattctttaaaatacagatatttttccttgagtcaatgatttacatttatagagagctttaaactcagaagtttgatttagaaagcaaacatttaaggtaacatgtcagaagttattattttaataatataatcatataattataaaactggttaagttgtagatttttgatgagtacttttgaattcaaaccatgaagagattttggcttttaataatagaatcgatacaaaccactagttcttaaaaaaatgggaactgagaaaagttagttctgtaagtagtaatttgaaagttgatgttctactgtctttaaatagtacatttatatatatattcctatatatacagtaagtttaaactatggctttcagaaagagttaagaaagaggaaattaactttcagcacatctgtagccaaatcttgatagtaattttaccagctatgtttttgcagtttgcagcataatggcttcttagatgagactacttccttagccatcattaattaagaaaatattttctcaagaagaatgtgtttccaggaaaatacattttggatagctttgtttcttgacagttaaaaaatatcttctaagctactgaggaggctgaggaaggagaatcacttgaacctgggaggcggaggttgcagtgagcggaggttgcagtgagccgagattgcaccactgcactccagcctgggtgacagagcgacactctgtctcaaaaacaaacaaacaaacaaaccttttgtcattaactttaaatcttttttatacctaatatgacttttctttatcacagaaaaggaaattgtgaatattttttggcttccaatggtatatggtttatgaaaatttaatttatgaaaaattttcaggtgtttgtattgctgatcagtgtcaagtagtgctataaatttagacaaattagagctatgtgtttgtccataagtgaacatgtctgtgcttatacattttcccctctttgacaaatgtgttgctcttcttgttttcagtacataaagggtgtgttttggaaagagcatatttacaattaattggagttctcgtcttcaatctaatctctgtaattctatgtatcagttctaaagtatacagcatttgatgaggaattactcaaaatataccagtaattaggaattgtaactttaaatgtcccttggtttgggtgataatttccaggaagtccaaagatgagccagtctataacctcagggagtgtttgggaaactcatctagtcatattcctgtacaaaccaactgttcaaattaaattacataaaagtttatgtaggaaatttcattcactcactcacttactcattcactcactttgttcatccagtcattcatcttctattcattgaatgtttttgaagcctgtcctctgggtcagaaaccatgcagttgtgaagaagatagacacactgctgtctccagtggagtgtattagatcactcccagcaaaaattgattgtaaaacagatttctcttttttcaaggccttttccctccaaagacttaccagtactgaagaaaaatttcttccgtggtaataaagtcaggaattgtgggaatggtatagggagaggtaggggcagggtgattaggaggaaggctggcagagaatcgaagactggcttcattcaggtcctccaattgccaaatggagattatgcaacgtttcttgaatacatacaaaactctagatgtggccagctcagtcttcttccaataatgtaaagccaaacaatgctttgcaggaatagactagagattatattttgggattaataacatagggattaaaatcttatcttgaactaactaaacattattgatatgctaaattcactttttttttttttttttttttttttttttagacagagtctttctctgttgccaggctggcgtgcagtggcgtgatctcggctcactgtaacctctgtgtcccgggttcaagtgattctcctgcctcagcctctcgagtagctgggactgcaggagtacgccaccacgcccagctaatttttgtatttttagtagagacagggtttcatcatgttggccaggatggtcttgatctattgacctcatgatccccccgcctcggcgtcccaaagtgctgagattacaggcgtgagcaacggccaccggcccactactttttaatatatcattaatttctcttttaaaaacagtagcaatcaataatttaaatattcaaatgaattcttaatttatatacacaaactaacatctttattatatctctatattttaatatatcaacatgtctaagataatttataaatttacatcatatataaaaatgggtttgctctcgatgtatataaggcttcatgatattttgaatatggagttgggtgaaaatagtgaatctgaatatttgaatttgaatatttattggaaaataagtagtgcttttaactttttaaatgagacacataatagtcccctgttgatttttttttatttttttaactttattaaagtatagttgacaattaaaaattgtttatatttaaggtatacaattgatgatttgacatgtgtacattgtgaattattcaccacaatcaagctaattaacattccctgttagtttttataagcctggttcaggtttgtagaaagaaacaaacacacatggccaggcacggtggctcacacctataatcccagactttgggaggccaaggcaggaggatcacttgaacccagaagtttagaccagcctaggcaaaatagcaaaccctgtctctccaaaaaagaatgaaaaaattagcctggtgtggtggcatgtacctgtatccctagcaactcaggaggctgaggcaggaggattgctcacttgagcccaggagtttgaggtttcagtgagctatgattgcaccattgcattccagcctgggtgacacagcaagaccctgtctctaaaagcaggcaacaaaaacacatgagcttcactacagggaattaaatacaatgagagtaataaaaaataggtgagcaaaaaaaatgcaaataagcaaacttttgagtatgatatttcattcttatcttgatttctgtttttaactccagattgattcttaaaatgctaacagttcataatgccagtgtaaacttgtcagtgattggactgaagaccttagatctcctcctaacttcaggtaatatgtgtatatgttttttgtgttgattcaaattaaaaaaaaagttgataccattaagtaaatgtgtgtgtgtgtgtttttttttttttttttttgaagatcaggattagggtagcttgatttaaatgtcctaaaattgcatctgtttttagacctagtgatgggacagccataatataatctaaatatcagttatttccaaaattctttctgtttccatctcttctccttatctcttttctctatactttgcctctcaaaaatctcattcaatacattggttttaaacattaccttatatattatccccaaatctctgttggtagtccgatgtttgctcccaaaatctggacctacatctcatattcccccaggttagtggtcattcctgcccttgccattattacttctttctccctatatatctttaataaattttctataatatatgttctggagtatgccataatcgttacattttgaaaacacatagtattacttcttgagtatttgctagatgccaggcttcacaagtaaaatgcttcacgtgcttttaaacacctgaatctgaaaacaccccttgagatagggattttatctcagttttctaagtgacaaacactgaagtgcagagaagttgctttggccactaagaggtagaaacagggtctgattctccatgtcaggttccttccctgagaaaactttggcctggtagataatggacctgaaaacaaaaaatcttgaaatgatgcaacagttgtgggcattgctgtgctggacactggctattatataaggttccgagaagaaaggccgctcacagggagctaatcttgaagggctgggaggagtttccttccatgtaggggagggctttttaggttgagagaagtatgggtgcagaggcctgggaggatagcatgagagaggctggacgtgtgattgggaaggtttgaattgtcctcatcagtcctgctaagagatgtaaagaccatgctggagaaagaggaagatgagagtatgagggaaaaacaagaaggtactcaacatttcactacagctttttatgaccatgttgtatggcatgcactaagagtctttaaccatgatttaatttaacctcacccttgggaggtattttttttttgacggagattcattctccatttggcgatggacaggaagatgagggtttattaatatgaaaaatctaccaacactggaatatattgaagttagcctcatacagtactactactcctattccagtattattatttttattgacagaatagatgctgtttgtgttaagttttggattatgataggaaatgtttggtatagtaaaaggcaagagtgtgacatgcagttagtccaagtacgaagagataccaaaaaaaaaatgtttagtgaggagcagagtttagcatatttggagtgaagacaatgtgcggaaggaaaggagctgatgagatacatgtactatagtcggttgtgtgaaaggtcttgtttttcatactaaggatcatgagaagatcttagtagattccagcaagggatttgcaagaccacatttgtgttttagaaatataatgcaggcaataaaccagttggatagaaattggggactgtagagcaattaagcaactgtttttgcattctagatgagaatgcaaaacacaataggaatgaaggtgccttgttcaaaaggagttttgttcaaaaggaatcttcaagatgtgtaggagatattcttaaaggacttggtaatgaattgatttgttgcttggatagagaatgagaagagaaaggagggtggaagaaggaagatgacttaggagtttctcttgggtagctagtggattatggtatcattgatgaagacagggaacaggagtaggccaggtttggggtaactgtggaatattcagatgttgtctaagaggcataagaatgtatttcagatgtttggggcaagttgtctaggctagaagtactgattgagactcatgaaattatagtaaagtgaactgggagtttatctcatttataaagatctagagcttgataagtctaacatctagggcagttaagtagtttatcaacaaacaaacaaacaaacaaacaagaaaaccatgggtctacaaaccattcacagtcttcatgtaaaaattaattcatgtaaaaattaacacattaaatgttaaagcagctctttactcagagcatattattctctttaaaataggtaaaatcaccttgctgatattggatgaagaaagtgatattttcatgttaatttttgatgccatgcactcatttccagccaatgatgaagtccagaaacttggatgcaaagctttacatgtgctgtttgagagaggtattttaaaatgtcaaattccttaaagtatatataagaaaaaaaggcttatactgggaaaagtagaacacagttataataagaagaaggtttctaaaatcctactatttattaagaagtgggagttgtctgtcaagggtgaggaatggggttaattcagaagtattgcttgttttggtggggtgaatttcattcgtgggttataaatcatgcccctggagtagactttcttcaattgcttaacaaggcataaggtttactttgaaaactggatgtgtgggtgctatgaaagaaaaaataaaactgtgaagccaagcataggttacactgggattatgatgttgagtcatcaccagaaatcatagaaattgcataaagagcctgaaggtttacaaagtgtccttcaggaaaaagactaatatgcatttcatagcctggccctgagattgataactgagattattatgtaattttagagttggttggagtccttgtttagtctttccattgaccttaggaggaagtgggtcacagcagtgaagtgagcatcctgcctgaggacacagagcttgtgacagtacagttcaattagcaattattttaagagccccttttgtatcattatgagagccaactgtgctaggggtttagataagaatgatttatgtgggccctgtgtcagttatcagtttaccagtctaatttcttgcagttcccagaatgggatagatcacctgataactgttgaattccctgtctcctcccagaaggattttaaacagcttatagataattataatacacaagagtaaacaaaatggatgagaaaataggtgaagggacaataatataaagctagattaagtttactgtgtttctaaggtcctgcatatttacaaaggggtgggccagaaatttgtctgtttgcttcctatctgacaaagaaaagaggtaaatatcagtggttacaaagttccttaagataaaagtaaacctattattcaggagaagcaattggtctcatgggagatctgagaaacatcttcccatgggttttcctggatgagacaataaaggacatacattttgcaaggaatacaaagtgtattgcagcgagagtgactctgtcaaaagtcagaatagcatgggcctggtacccagctctttgataatcatacaccgtgaagtagaagatagtttacagcgagtacggaattccttcaggctgtcatgtataaatgttctatcttgcaactaagctttcgatgacaattaggataaagtttgaggttctattgtcttgcagggtctgtaatcttctgtgtggaaggttaggggcacattcttcttcctggaaggagggctagcatcactttatcaccatcgttgtttagtccatctaagacactggaggtagaccatagaatgttacaaagaagaatgttgctcaatagaaaaaccatcagtgctgagagggttatgactataaatgtagagtagaaaaatttctgatttttccaggagtatcaggttctccaggactcaggggtgactataaagttaattttcaaaatttgaaagtgtactgtggaaactagaccataaagtgagaaagttccatgatattcttcacttgttaggaaaacttaactgatttcacattatattatagggacactctggcataaaattaaaaaaaatgaatgttgatcacttagagtgctgtgttttctaacatatttctggcgccattctcaagctagataaactataattttatacatgtttttcaggttgttgcccaataacaatgactccaaatggaacttactggcttgatcaaatgactttaattgtgaaaattaatgatttatatttttgctgtctgatggaaaaccactaagacagagtatttcaaagtctgattacttgccatttgctcaagttgacaactcttgaactgaaacatttagccgagctgcccttcagcagcctaccattaatgcctcccttttaaatattgcaatatgtccagttccagttggccatctttattagtcactgtcagttttctctagaatttcccaaatgaaattgtaaataattttgtttttctgagaactgcttgctgactagcacttttacatttcaaaacatggagtacctaacataggccgaaacaaaattatttgaatctccgtagcttgttttctcattataacattcttaggaagggctgcttcacagaaatatattttttatttaaggagattacacttgatgtatctcacacaactataatgaatattgtaatttttgaataattaaactttcatatcatctttaagcttattcagtattttgtctttcatttttaagtctcagaggagcaactgactgaatttgttgagaacaaagattatatgatattgttaagtgcgttaacaaattttaaagatgaagaggaaattgtgcttcatgtgctgcattgtttacattccctagcgattccttgtaagtagcatttaaatgttatttattttttgtatctgaaaaattacaatatatctcattctgagtatattttaacaatatttttattatttagaaacttgtggatgctcaacccattcattcatttattcatttaattaatttacattcactgacattatactgaagttggctgtgggcttggtgctggagaaacaatcgtggaaaatacagatgtgttccttaccttttcagagcttgtagtacaatgggggacacagataagtacagaggtgattacagtggcagaagtgatggcagatggcagaagtacctagagttaggagatcaaataggaagtgaggcagtgtctcttagcaaagatttaataagtggagcttcctgtgcatgaaggtgtgacctgaagtgagaatgcaggcaaagtggcccaggcagtgggcatggttaatgtaaagatgctggagcaagagagagcagactgccttcaagaagacaaaagtagctcagtaaaggtgtggggttatgagtgtgcgtgcatgcatgcgtgtgtgccgctgtgcatgcacatccccaaatatcctatccgtttgtgtttcattgacagaggcaagggagagcttgataagaggcagtaaatgaggccagagacatggagtggagagcatgaagggcctaaaaagccacatgaaggagtttgaattttattgtgactcttgattagcattttaatgaggctttgaaatttagccacatttttcaccaaaaatattaatcagaagaaattaatttgatgtgtatgctaccaatgattgctattaggctaaaataatggttcatattctgttttgttttgtattaatggttcatattctgttttgttttgtaagtgaccattaacactttgtattttatgtattacttgtgtgggtttctacaggatatacatatgcatttatctagtgatattttcatcctcacacatgtgaagttttgaggattagagttaaacaatgtacctggtatgtaataagtgttctaaaatcactgacaggattattagacaatatgtattttatatgtgtgttgtatactatatgtaattgcatttatggtttcagatatggaaatcactgtgtcaatctgaaggtgtgagccttcggtgtaggcagagtaaaacccaatgcccttgtgaaagaatgcttttttttggtgatgtttataaaatcacaatgttttcttatccacaggaaattaaacactggaaagtgggtggggctgaacaataatagagaaaggccatggttttacatttctctgagacatcactgccaacaaactgaatatgtttttcattatactttttccttggctatatttattcatttatttatttattttgggctggaggtttttggaatccattgttttccacccacattggacataactccagtaaaaatgtgttgattcataatgcaaaagtcaagaaagtagcagctaaaaattaagaaatcaaaagtttttaaaacactgattctaactgaaaaacatttgcttttcagtctttaagtctattgttctgagtcaaagcagttcatttccttacgttgttaattttttttctatgtttaagcattgtaatatactttttgtgaaaacagttgattagttttggttgtgccaaaacaaatactaaaatgttttgcaaacagcctttttttaaacaaaaaaagaacagttaacatttgatgcagagatatacatgttttctccatgtaggttcacacctcacttcctttattgattaattgctttttctggtagagtctttctttcctttctgttttacctgtgtttgtccctaagacttatattttaatattatgcctcctctctttcgttctcccatcttttcttccacctattttggagccttcaggaagcttgattttgctgccttgtacattggttgcccttctggaatggaggaaacaggtcatagctgattttaactgttccatctggtgacatattcttgattttctttcttttggttggggaaaaaaaaacaatgcaaaagtcattctccaatggggttgagcctcgttaagaaatagaccctccacaatggttgaactagtttacagtcccaccaacagtgtaaaagtgttcctatttctccacatcaaaaaaaaaaaaaggtaagcaatataacatgagccatatctaataggacttcagaaattatctatcctatagttccaggatgacgatgatgatggttgtgataatgatgaagattgtgatgatagttatatgggagataaaactttaagcactttacatattaaattctataatattcaccacatctattaaaatatgttacattattgtccctattttaccaacaagaaaactgaccaacaagattaaacaacgtgactaagttcacacaacctgtaacagcagaatctatgtcaatcacaacacaattagcagctatttctgtggcaattttcaataaagatgtgtctggaaaaaaaaaaaagaaatagaccctccaatttatttatctgaaaacttatgaccaatacattacatttccagactttcattttcagtacttttcctttcattttcagtactaaaagtactctgaatttttcctttttttgatcttaaggctttaagccaagaaacaggaataaagtaaattttccttaatgccaaagattagtcctacaccccattatgttattaatgaacagcatagtattttttacagctacttaaagaacatgatgtttaaatttggaaatgcagtcattatgctgccatctatttacagtctatataagacgtctttgtatgcatatttgaaaggagaacatggttaccttattgataattatgatctctttaaattcaggcaataatgtggaagtcctcatgagtggcaatgtcaggtgttataatattgtggtggaagctatgaaagcattccctatgagtgaaagaattcaagaagtgagttgctgtttgctccataggcttacattaggtgagtttcttagttaatatgtcatcacacactgtatgatatacatatacatataaaacatatatatgttgcataataatggataagtagcatattgacatactttgaatgaaaatattgtaaaatcccagaaaaaataaattaaaacaaaaagaaaatactgtaaattaccaaactgttctgctgtgcttagatggacttttaaaaggagtgtcaaaaatagatgtgtagaatgtaaaagaagtattatcttaatcttatttttatagatgtagttctatagatgagtttttttattgttgaggctatatttaaaatataattatgtaagaattgatacatacaaaaatatgcataacatatacaatataaagcataatgcaaataactcactatccaacttaaatgttgtatattcccagtgggggaagctaccctgggcttcttcctgcccttgctttctctatagaggttaacactatccagaattttgtgtttacaaatcttttgtttataaatatgatttactacattttcatgtttctctaagcaaaattgttaatgtttgcctgcttttgcttcatcaaaatgtaatcatactgtatgttgtcttctgcaattttcaaatatcagtgctatgattataagaatcagaaatatttttgcatgtggttgcatgtagtattctattatttggaaataccacaatttatttttccatttttctatccatggacatttggattctttcttattttatgctactactatctgtgttaaaacagataactgaaaaagaacagttaacatttggtgcagagatatacatattttctccatatataaataagggttaatattttaaaaaatatttatttgccattggtatgtccttctttgtgaaatatgcaatctgtcatttatcaatattgttcacaggatagtctgtctttttaaaaccgattcatagattctggataataatgttttggtggtaggttatacgtattgaaaataccttcccttgaacatcacactctggggactgttgtggggtggggggaggggggagggatagcattgggagatatacctaatgctagatgacgagttagtgggtgcagcgcaccaacatggcacatgtatacatatgtaactaacctgaacattgtacacatgtaccctaaaacttaaagtataataataattttaaaaaaaaggagatgaagaggtagctgcaggttgactgagcaagggtcattgtctatttgaagtttcaaaggtatctctgaaaataaacacagttttttgcaagagtgaaaaaaaaaaaaaaaagaaaataccttcccttgacttgtagcatgtcttttcaccgtctttatggtggcttttgtgatatagttaaatttaataatcagttcctttgtgatttactcttttttatgtatcttgtttaagaaatcttaatctgtcctttccctaagataataaatatattgtatattttattccaaatcttactcgtttgttaaactgttgcagtttgtttttgtaaagaacccaattccccctctttttttcagtgtggagagctagttaccatcacagcacaatttattagaggttcacctgtttcccagtcatgtggtatataaatatgtaaacatatatgcttatgtttctgtccttggcgttctgttgcattaatctgatttgtctgaatcagatttaaatctgatgttaaatataacactatttaaattaatagttctgtaagtcctgatatctgaaaagctaataggtcaagtcaccatacattcttttttaggcacagcttgccttttttcttgggcctttactattccatgcaaattacaggattaacttgtccagttccttggaaaacactgttgagattttgactggaattgcacaaaatatgtggatcattttaagaagaactgacatctttacattataatttcttctatacatgtcttgcacatcttagtttttgctacgtatcttattttttattattattgtaaatggtatttctttttaaatcatatttttgaactgtgttttcataaagaaatgcaaatgattttttgtatattgaactaacctacctttctaaactcttcgttaattctgacaatttgtttctaaatgcacttaagttctctacctagcaattatataatttgtaaataatgacagtctgagttcttcctttctgcttcttatattctttatttcatttccttgtcttcttacatgagtcagaattattaatatagtgttaaatagagccattgatactagacatccttgtcttgctctttttcctgattttaaacagaatatttttaatattctcccatccaaaataatgcatcttacaagggtttaaacttttaaaaaaaattttgttaagaaattttattttatttcttctttgcttttgttttttcaatgtgggcttttaaatgtttgcttttatttttacaatgtgggcttaaaaatattaaaatatttaattttatcaaatatacttaaaatgtagtaagtcttttttttccttttcattatgttaatatgaagaaatacatctacaggttttctaatactaagctactgtgcacttcctgataaatttaacttggtcatttattagatttttaaaaacacttctaaaaaatcttctctgtttattttcacatataccaggtgagttttggcagcctcttgttttttcttttttaccctttcttttttgttaaaaacatccttttatttatttaatgattaatacatggctattttgtgttttgtatctgataactatatataaagttctggggagtctaaaccaactgcttctaggctgactgcctgtcagttgcggagccttgttttcttgtatggttgtgagtttctcttttattgagcatcctgaggacttaaattaaagatgctctttcagaggtgtttgccaggagtcagagcacaggactgacctgggagcagtttaggatatgatccaggcttaatatgggagactctggttgagaccttaccttgcagagagtctgaaactggtttgttgaatgcagcgccaggattcatgctttcccacaagactactctggcgttcaactcacagctcttgtttcagcttctttttgaactccctctgcccctcaacacacaccttggaaatttccttgatatttttgtgaggacaacaatgcatttaaaagtgagagtggttgctgaataataaggaatgatcgttaactgttggacattgattctgatgacattttctcaaaaggataaccaggaatattttgtacaaaattaggattattataataggcatttagtttttcattgttacaaattttgaggaaaatcattaatcatttgaaaaaactaattgacatgtctccattgtagcaacttgtattttcacttctagtatcatgattatatcccctgtgtaatttggaaattgattttagcattaggaaatttcctagtttcagttaaaatgaattttttgtaagctgaattctattttacatgcacaactttagtttgttatttctttccttgacaagcatttattgaatgttgttatatgactaaaactgtaagatgataatgttttaatattttcacatttctttcatagcttccaaagtgtatatatatactcacatacttcatatatatgaatctacttatatactgtatataaaaatatgtatataaatatatacacattgtatataaatgtgtatatatatttacacatgtatataaatatacatacaaatgtatataaatatacatatttatacacagatgtatataaatatacatatttatacacagatgtatataaatatacatatttatacacagatgtatataaatatacatatttatacacagatgtatataaatatacaaatataaatatatacatttatatataaatatacatatttatacacagatgtatataaatatacaaatataaatatatacatttatatataaatatacatatttatacacagatgtatataaatatacaaatataaatatatacatttatatataaatatatatattttttgatacgtacaactatcttgggagatgggatattgttattatttccacatttacagatgaggtcctgtggttcatcaatctttgtgttttattcaagattatgtaagcagtaagggatgaaatcaggctgagaacccaaatttcttcatccctaaacaaagtatttcttctaaacatggtatccatttactagtttatctctatcaggtgaccctttattcattatttttcatgagaaggttgtagttgtacaaagtggctgatatctgataatgttttaatctaattcaaagtcgatttcttaaatccaggtgtcagagtagcacactactgtacaattctctgtttcatgttttacaatttaccacagtcaagttacaacttgcacatgttacattaaaatgtgaattcaccttaatttcttgaaatgagccagaagaagaagtggttttgttttgtgatcagggaaatgctacttgactgccaaattgtctagaacagcacattaaagttgcttgattttatactgttaaaattaaataaaacatggcaactgtcatgtcatatgtaacttttgtattattctgtaactttttttgaaaataaaaagtgatcaaattgatcttcaggtaaagaatcttttttctcttgattatctcttagtggatgatgatttgttccatttaatgggtagagaatttattgttgctgttattgtttcaaaagtagctgaatgaaactcttaactttttcttcatagttaaaattaaaacctcaagtaaataaatatttaacgttttgccaaactatgtaatctaattatgggcttaatgcatttaaaggctttgtataatttgctacgtattttcacacaagttacctgaacataagtccagtcttcctgctgttttctgagtcacacagtgattcagtgaccgaacagctgttggcagtggtgtgggtataatagggaaaagagactgatggggacaacccaagtttagacaagctggtaaaagtagaagaaaatcttcttgaaaacactagtgatcactaagggctgtggagaatttttgcttggtgggtgaatgtggaagaggcaacagcatgggaaggtgttggtaaaggagctccatacttgcttaaactgccttttgattgtgaggccgttgatgaatatttagtttgggctttaggttttttatgatacaggatattttccatttctggctttgtatctcagagatcacttagttacacttatagatgaataggagtttcaattccttgttttagaaagaagcttggtaactgttagtgagttacaaataagccaaatagaagaaggtacatatttctgcagtatcaggtaaagtttttcctcataaggatttagactcttggatatcatattaattctcagaagagtgggtataaaaaggtatgggacttcttcctggggtgggttggaggtggtgaaatacctttttttttttttttctgagatcatcatagacaagatcaaataatggtaaacatgccaatgaattttctaagcactattcctttaagtgaaagaagagtgtttcagtaaaatgatttaatattgggtcttccaaaagatggatttaagagtttcaactttaaaagacagaaaaattaagttattttacacaatgaatattgtcgtgccgtgtgtcacagacatgacatgagagggaatcagagaacatacagttaatacaacgcaaactagtatcattacttttgctcaatcacttccattgtctaagtaagataattaaaggacagcataaaataaaatttcaaaactttactcaatcatattaagctattttaattaaagtaaatgttttaatgccattgaatattcatcaccattcaaaattattgatgtaaatagtgttatatgttaaaggtaatttaacttccatggatgagaattcagctaatgtttcacttaacttttaggtaattttttcaatatcctggtattaaacgaagtccatgagtttgtggtgaaagctgtgcagcagtacccagagaatgcagcattgcagatctcagcgctcagctgtttggccctcctcagtaagtaacttcactaaaaaggggattcttacagaggcatttgacatcaaatatgaacattgtaacaagagaatcatatgtacagatggaagcattcaatgccttttctgtcctgtgtagctcattttccagtagaggatactttcaaggaaactaacagttgtgacaaatatacacatctcaatgtagagttttgctttacatcattcttgatttagctttgtcattaagcagctaatctgttttaaaaaaatttttatttgtgcctgggcatggtggctcacgcctgtaatctcagaactttgggaggccgaggcgggtggatcacaaggtcaggagttcgagaccagcctggccaacatggtgaaaccccatctctactaaaaatataaaaattagtctggcatggtggcgggcacctataatcccagctgctcgggaggccgaggcaggagtatcgcttggaactggagggtaggagttgaagtgagctgagattgtgccactgcactccagcctgggcaacaagaatgaaactccatctcaaaaaaaataatttatttgtgttttaagttctggtgtacacgtgcaggatgtgcaggtttttcacataggtagacgtgtgccatggtggtttgctatacctattaacccatcacctaggtattaagcccagcatgcattagctatttttcctaatgctctcccttctccagtcccatcccctaacaggccccagtgtgtattgtccctctccctgtgttcatgtgttctcattgttcagctcccatttataagtgagaacacgcagtgtgtggttttctcttcatgtgttagttatctgaggataatggtttccagctccatccgtgtccctgcaaaggacatgagataattcctttttatggctgcatagtattccatggtatatatgtaccacattttctttatctagtctatcattgatgggcatttgggttgattccatgtctttgctcttgtgaatagtgctgtgatgaactaatcttttcaaataatcctcctctcgtctattaggttttttttttttttggtaccttcttcctcattttattatttatctggataggatggtagcattatgagacgtataatatattaaaaattatctttataattgaccaaggcttctcctaaagcacacctcattctgttggtaatatttcaaaatatggacttagagttggtcaaactgttaagtagataatatatataatgtttttatatatttttcaatttttttcaagctgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggtaggactctcataaatattagagttattcaaaattatgttttccagtcatttatattttgacagatttcttttttctcccctaatccaggaggccgcatgctgggcactaaataatctccttatgtaccaaaacagtttacatgagaagattggagatgaagatggccagttagtagttttgattttatatgatagaaaatttcagttatattttaaatcaatacctataaaataccttaaccgtaacttttattgttagaaatatttttgatataggcatttagttttagatgttgctgcaaaatagtagtaggtatgtagtattttgatctcatcaccttcaggagttagaaaaggtagaatgagagttattattgagagatttggaatcaagggtcatttggtaattcatgaatcatggagaaagaatctttctattttctggctgatcgttttaaaatgccatattaattcatcttgggtgatagaaattgcagagccatctgtgatcttttcttctatggtgactagccagcaggttgtcaatatcagaaattagatttggttagagagcttcctatgatgagttcccaactgatgtgacagagttgacctgtcttctttcgagagggttatttgaagctgtcatctctggataactctttcaataggagtgccattcaaacatcataagaccggcactctctcccaaagatacaagctgtagcaaggagttttgtgcatatcaggtttgtttcatatccgtgagcctttgtgttttatggcaactgattgattatacttgtgctatttgcaatgggtatcctctgggttttaaatagtgaatgacttattttggaaacaaatagtagtattctatgtctgaaatcttgaccgtctatttgtttaattatctattgctgataagaagggaattaataacacagatgctacttaattaaatattttcattttgacaagaaacagtaattcttttgaaaactatgctaaattggcatcttaataatctcatgttgagcaaggcttttggagattagggtaagggagattcatgtcgcagtttataaatttcagttcataggatacctatttttcaatatccataagataactttaaaataaatatattattaaaacaaagaaaatatatttacgttatacatctttaaaacctaccttgcttctttacaattttcagtttttcctctcttgtttccattctcttctcctcactttacctttttcctcagcatctctttacatatctgctgagcttttttatttctctctgctgcatatgcttttgaaaaagcataaaaatactaatttgttaggatttaattaattcgagtcttaaaaaatgaactataattcactcttgtaagtggaggtggcatgaaatattgtttatatgctcttaattgttgttagagatatttgataatggcaagtgagaatttgagatagttatttaaaagattactactaacattttgtttgaatttttgaaagtttcccagctcatagggaagtgatgctctccatgctgatgcattcttcatcaaaggaagttttccaggcatctgcgaatgcattgtcaactctcttagaacaaaatggtaagcagtgggccatgttttcaaataaagggaaacacatttttgtggtatttttaattatagaagctatatactgtgaaaaatttacataatttataaagctatatattgtgaaagatatctctatgtgtagagatgtattgacatatggattatgaatatataggtaaaaggatgaagaataaaataaacatttgttgtatatttttccggacttctatgtgtaaactcacacatgacatatacaaaattttatgtattttgtagaaatgggatcatattatactcttttataaccaaattttatttattctcttttttatgttgatacatgtgtattctcacattatcattttatttttaattttttaaattaatttttgtttttagatatggtctcactctgtcacctaggctggagtgcagtaccatgatcatggctcactacaacctcaaacttttggactcaggtgatgctcccacctcagcttcctgagtatctgggactacaggcatgcactgccatacctggctaattttttgcagagatggtgttttgccatattgcccaggctggtctcgaattcctgggctcaagcaatccatctgccttggcctcccaagtgctgggattacaggcatgaaccactgtgcccggcccaaattataatttttaatagctttgtagtttttcagtgcttgcctgtattctgttttatgaaccaatttcttactgatgaagttttagtttgtgtccagtgggatgtttctggaacccatagtaaacaccagtgatcactttcctcctctgttttcctttatacatggttcctattattttcttgggaaaatttcatagaaatgcaactgggtagagagctattcaccattttaaaatctggtaaaattgtctattataaatttccacactatacttttttaaaaaatcgttctttaatgtaattcttataaatcttatagctttgtataattatgaagagaaaaatggcttgtatccctttagaaagacatgagttttaagattatggttcaggctgctcaaatttcttcccccataaacaggaatactgccagaaatccttaggtgaaaactcatcataaaggcattgggacttggcagcttttgcaggacatttttagagggcaaaaaatagagaaaaacactgaaagtcagagacagagaccagtgtaagcatcagcttttaatagagaaactgggtagggtggaaaaaaaataaagcaaccacctcatgcatgtttctttatattattattgaagtcaaataaagaggaaaatcatttcttcttcctcttcctcctttttcatctcacctctccaatggcactttaataaaacgcttggagtggccagggcactgacagacagacaggggctgctctcaaggataatgagtcaaaggggaaggagagggaatcgctgttctcgaatctctcttattctactgtgcagttaaagaggtctggacagggatttcactcctgaaaatgaggactggactttgtggcttctgttggggcacctttagagtggaggtagacttttactatgtacagacaacattgtgttggtgacatcattcataaccacctggaaatctcctttgatatgcaaatcaaacaaccataactttgtgaaatttcgactgcttcctattgtggtgtctgaggactggttacattcagagtccaccctgatgtctttgttcagttttctgctctttctagttccttacttctttgttcctgatcacctgtcaagtaaaatgtcctcagatccttttgtattgtctttggagttctgccttaataaagcatgaagaacttgagtagctcgttcatcaactttcttgggcaatttctcattgaaagacacttgggtgtctttgggtgtgcagagctgagcatggctttatgtttttagaaaaaatggctacattggcaggcagaagaactgcgtccttggaatcatggaggtcccaaggttgcatacattttgtgtgacatttttcctattcaattaattaactaatatttattgagctcccaagtgtgtagtgtctgtaggcacttgggatgcattcattaagtaaaaatcccaggctcatggagtttaaactgtagtagggaagataataagattaactaaaatatgtaatatttgaggcagttaagaataaaaaatgaagcaaggaaggagaatatgatatgttagacatcagaggagatgaagttgtgaataggcagccaggaaagaaggtgactattgagtaagacctgcagggcgtcgcatattgttttttgcctctgaaagcagttaatttcctgttaaaatggagtggatgagatcaagagtattacgtagatagctggtaaatgcgatagtgtgtaaaatgttctataaagtctaacgtgactttatgatgaaatttcttcttctaggtttattgcttgcaattttcaaaccacacattgggttactgtctaggatagtgattcttaaagtgtggttcctggaccagcagcatttgctgggggaacttgataaacagtgtaaattcaaggaccccatacagaccttctcaatcacaaaccctggagttgagacccagcaatccatgttttaacaagctctccaggtgattctgatgcacactaaagtttgagaaccactaacccagtgtcatttttgtcttttaaagtgtcttcttggctagaagctagccactttgggaaaggttattacaacttctgatgtgatcaagcaaagtaaccaactctttattgtatcttaatatgtgatattctgaatgtgtttaaaaggtatgagtttttcaggctctggcagtattttagaatgtgtatgtgatttctatttatttccatgttttgtcctatcttcttaagatagactacttattttaaaagcagtacttaagttaaaactttttatgtttctttttctgccactttcaaagtgttgaatcacagtgtgtaatgttggaactgatatttttatagcggcttcaagacaattgatatttatgtggaaacttgaagacagtaggtttatgtttagtgaaggaagtttattacaaagaggaaaattggccagttgtggtggctcacgcctgtaatcccagcactttgggaggccaaggcaggaggattgcttgagctcaggagttcaagaccaggctgggcaacatagtgagatcccctctctacaaaatattaacaaaaattagccaggcatggtggcacacttgtagtccctggtacttggaggctgagacaggaggatcacttgaggccaggaggttaagactgcagtgagctatgatcatgctactgcactccagccttggcaacagagagagatgctgtcacaaaaagaaacaccaacaaaaaaagaggaaaattattccttaatcattattgctggaatatagttactttccacaaatagtgaagtgccagttgtaaagcatatctatatgtttcctagactttggcattactttgtgaaaataactgtaattacttatgttctatgtaaatgctttccattcatttgtatatgatggcatatatagaaattataatgtttgtaaagtccactgggataaatggacaaagcagctgaaggctgaaagcaaccaagccttttacagccccttcattccccacactcccaaaaagctgagtgaatggtcgatacctccacatgcttataactcattcccagcccaccagtgtctagcatatctggttagtcttagctttatataagtgcagttatttgtgaacttgttttaagtattggaatacaatttaactttcattcttattttggagaccattatttaaacagatttcttttttcctgcaaaaacactcttttcacaatggacagagacacggtgattacattaaaaccatctactctatgaataaaaatgttaaaaccaaaatcccaacaaagggttaataaaggcaaaaaaaattggaaatgacatgtgttttaaagaaataaacatgaattatctttaagctgtcaatgaactataaattatgtgtgctcttgtatatgctttcctgtaaatttggactatattaatattctaaagcttatggtaaaattatgaaaatatgctttcatatctataagtaacattttaaaaaatctcagttaatttcagaaaaatactgttatcaaaaggaatacacctgaatgttttggagttaatgcagaagcatatacattctcctgaagtggctgaaagtggctgtaaaatgctaaatcatctttttgaaggaaggtaatatagattcattaacttgtacagaatatatcatattgggccaggtagaatatcaatatttcaagcatatttctaacaatgaaaagaaaaagaaaaacataagacacttgaaaactgaagcattttgcaatgtaatctcgtgtcactagtaccatagacttactttatctgaacactgaaaggaatggcaagattgtggaaacatgttgaaggtttgcttttgaacctgatgcttgatgttgactatattttgaaaagtggtaattgtatagcacatagcatacagcagtttttctaattattgtgtgtgtgaaagttataaaagataaaatcagtttatggctaaattttgctctttcacaacgaatatattattccttcatctgaatgaactttgtcttctcttcctgctctcaatccttagttagggaaaattttaactacatctagtccaagtgcagagatgctaagattatatagctggcggttagtggcacaacagagaccatatcctttgatctatgtgtggatggtggtggggcagggtgggatgaggtgggggtgaggggtggtaggtgtgggcagaactctcatgtgtaaaaaaaataattggcacagaagttgcagtgaaaactaattttgttcctggttttgccactaatttgagccaactgtttcatctctaaaacttcacgttcctcattgataaagaggaatgataataacaactttgaaagttgtaagcttagaatgtaaggattaaataaattaatttttacaaagggattaggataatgcctgctgcattttaagcactcaacaaattgtgtctattgttgttatactgttactaagtgtgaataaatgaagtgcatatagcatgaaatgtagcgtaactgcagacttgtaagaagtagggttacactgtttttaacatcagtctaactaatctatgtttatatatctttctaagctgtatttctcttatttaagtgttgtttttgaacactgagatgaaaagtttatcttaaatgttgattttaatggggccggaagtgtgcaaacctttacaaatgaggcaaaaacacagcggaataaactccagtctaggattctgtagattctgggcaaggcatttaatgtttctcgctgcatgctcttacgtaaaatgtgtacagttgcagccctggagattccgcattggctctgacagtgtgtctgcccctacagaactcatgtgagtcgagagactgataagtaaacagattattataatacagtctcagaatgcagtggcagtagtgtgtaaaagacgcaatggtaagagtagagtggactcagctggggttacccaaggaggggaggctccaatggagggatgtgtttaaactgggactttaagttggaaaagaaggaatgtatctcagtgtccacagaaccatgcaaagtgagaacatggttctgatatgcacaagtttcagttaacaagcaaagcaaggattgactgtattaaagttcatagtacctactgcattctagtcaagtgacatttgctcatatgtaaaagaaagaatagcttaaatacctgagagaaaccaagactgtaaaacaaattaaaaataattaaaaataccttataagaagtccagtgatgttaatctggaagaggaaggttcgtgtgatgtaaagaggccttgtcttggggtcagacaagtttgggtaccagccttgtctctgtcactttctagtgataagacctgaatatttaacctctatctgtctaagttcttcatgtagaaaatggggataataacacctacctgctgggattgttgttattgacccatcgtaggtcagaaggatgttgttagttttatgaagtgaaataattcccggattactatgaattctatcttatgagttcaaagtttagacaattaaaattatgtatgctcatactactgatttcaaatgcattttcatatagtctttcctgataaaatatattggttctgccctcctgtacttatttcaatttggtgtttataccattgaatcagatcagtctttcaataagcatgccaattttatatccccagcaacacttccctggatataatggcagcagtggtccccaaaatactaacagttatgaaacgtcatgagacatcattaccagtgcagctggaggcgcttcgagctattttacattttatagtgcctggtaagttacatagttgattgtgggaagagataacaatttaaatggatttttgatttttcatgaaatagcaatattctaggcaaatattaaaagactagtttctgtcgactaaatgtaaatctttctgttaaaccaaaaagaggttaaatatgatgcagaagagtcacttagattaatttttataagaaagcaatatgaattcagtaatttatttatacaaagtaactacaatgtaaaatgtggagcttttatttttaaggagggtgttcatctctgataattcttttctatttttgttgccatgacctgagttcaagctttttttctcttgtttgaattgtactattagctaattttcatacctgttctcttccttcatttctatccttttcttactctatgattgaattaatctttctccaatgtggcttgtactcatttacctcaatggcttccaccctccacccacctttaattgttactgacatctgttatcaccttatttgttctccaaagcccctttaaaacacctatgtctgtattcatccaacacatttattaagtgcttcttatgttctaagcactgtgatgctgttaaactttaaaagatgaattggaaaaaaagcacaactgtactattataggagcttagaggtagatggaagtgtaaatagataattaacaggcagcgtgagagaggcgatgatagatgcatatataaaaggctttgagaatatcgatggaggcacaaataatttcttcaaaggagtaggacagagattgtaatatttgaggtggaagggtagatagagctggcctggtagaaaggccaaggaagacatttcaagcagaagaaagtgcacatggtcgggggtgagtgaggcatggaggataaggagaggagtgcttggggatgagtgtggaaggaaaggctgaggcccaaagaaaagggccttgaatgcagtgctaaaaattttttgccttttaaaaatggaagccaacccaagtttattaaaattgtttgcagattgtagtgtcacaccgaaatttgcaactaaagacaatagcattgtggtgcagaggatgatagacagggagagagactagatacaaggagattgggttggaggtccatggtagtcaagtgagacccagtgaagggacccagcaatggaaacacagatgagagggcagattggacagatggttgggagatctgtttgatgtgacatcgtgatccctaagtatgagggatgatactttgttctgtgaagttcccaatcttttgaagtcatttttgctttgttcttttaaaatgaaatcttcctaaatctatcattttctctagttatataggtattttgtttctctgtataagagtattactcaatataaaagttttttcaaggacagagctttcttcagtcatttttttctgggccccccagtcctctggtggctattcaatcagtattttaaaaattgaatcatggtgtcctattcatagtttcagcttagttttgagacgtaatgtaacagatgtaattttacttgaaaatattattgcatgttttattgaattttatttttagattgtaattaaaaacaataaaaatgccttttgattatccttaaagttgacagccttattcttttgagggaggttttgggttttaaagataaccaaaggacactcaaaaaccgtttctgttagttaataaaataatactcttttagtccaaaagcaagttttgaatacagtatttcttttcttttattgttcttaaactgatcctgaaggaaaattgttagttaacaatcaatcagatgtattatgggtgcccttgaaaataatcacttgaggactgtacttaatgtaaaaaaatacattttataagcatatcagtatgtaagtacattcttctagtaggtaaaggcttaatcatttactgtatgctaacatattatactaccacagtacaccatactgtactgtacccaacgtaatgtaccatgccgtgcagtaccgtatcattctaggtatcaacaagtaactatggtagcaatactccagtagttttgaggttgaatatgattctggtttgaacatgttaagttgaggttcttatgagatacctaggtgtacatgtattcatttattagctagattatattcaggttttttagtggcaaagatgtacattatggcaaatgtgtataatttagggtccaattaaggatagcatattgcatctagtgcatatatcttaagtttctttcaatctattactgtactttttctcttctactttataataacttgttatatagacattgagctggttgctttaagaaaataataatgaagacccagttactttaataaaatatcatttgacttgtttcttgagttactgctagttttagaggaaataatgtgaaattctttaagaagggatataggcaaattgggaagtatatagaggagagtgattagggagataaaagcacatcaaaaagagcaataagaggaactgagattgttttatttgaagaagagatgactcaaagggatatgaaactctattcaaatctacttacttataaccagtaacagtaataataccaaacaatatggaggacttaaaaagtattaggcattgtttgaagtattttaagtatattatctcttctgattctaacagcactccatgaggcagatattattattattattattttggtattgtatggactacaaaactgaggcatagaattgtagagatttttaaggtcaggcctgatataacagcaccagattttcagcttatgcaggctgactccagagtaggcattttaaaataaatatttgtgcaacaatcttgtcctgaacaactgttgtatttaaagcactatgtctagaatccttaaggtatcgggagatgatgagattatggatactgctctcaaaaaaatttacagtccacacgacctaaaggactgttatgtagaaaggaaattatatccatttgaatagtaggacctcaagtgatagaacaaagactggagaagaaatttacaggaatgttcatttggtcttaatttaaggaagatgttaaataagacccattacatgtagcatgatgtttttactactcaggccagttttagtggtcacatcttcttaaggtgtaataggcagcctcagaagttactgtggtcttgctcactggaaatgatacacagacagtttaagggacttgccccagaccacacggcaagaggtgaatgtcagaacctctttgagtacattttaaaataaggactgaaagttggaggagggtggttatcaaggctgccttccttaccatagtattcccagcattaacaaaatccttggcatgtaattggaattcagatgcttcttaaataaatgaaaagcctgttgtagccagcttacagtttgcattaatgcagattattaaagtggaagatcataaatgattttttattaatatttatgtctataatcttaggtttggaaaacattattcattcataataattttaattatatgttacattaccacatttttgacttgtagtgtttttagcatagttcagctacagtgtagcttaataaagaatatgattttttaaaatagcaatgctattatatagcctttacagaacttctaaaaaatgacatgttctctaccaccttaatactgaaactcaaatcttattttttgctacgattattccagctactcttttttgtctatatttcatttctgcctttttatgttgtggtccaagtaactctgagcttttctcatgttgtccattgttgcataaaaatcttccagcatcttaaagcacagcctactcacacaaaaaagtgattgtttgctacagaaaatttcttcaccatcgtaattttttgctacttcaaattcagtaagcattcttacacattatatttattttatattcagtgatgaactatttttatagattccttaaaatttctggttatttatttgataaggaaacatgtactagaaaaaagtacaacacatatattgtgagattaattatgacaatttctagaaagtaacagtctgttcaactcaaatgtttataagaaaattctttctttatttatttatctgtgcatttaggcatgccagaagaatccagggaggatacagaatttcatcataagctaaatatggttaaaaaacagtgtttcaagaatgatattcacaaactggtcctagcagctttgaacagggtatgttgaatataagttttctgtatttatactattaactaaaatattaaatttggagaactaggggcgctttttcagtctaagttttctgttctccgtttgctatgataggaggaagtcatgtggttagagacataagatgacagtggggatgtgggaagtgaaaagatatgtactaagctaagtccagctaagtgtattatcaattatagatgtaggcaagattcttttgattgccagtaacataaatccactctagtttgctcaaccagaaagagaaccaaagagccatatatgcagctagaccttgtgagtcatgctgggtactatggctgctgttttctctttctgtcctctggctacttgtctttcttttctggtctcatagtatatggtttagcccatgaagacataccagtgttaacagtaaagtcttcggctgggcacagtggcccacacctgtaatcccagcactttgggaggctgaggtgggtggatcacgaggtcaggagttcgagagcaacctggccaacatggtgaaaccctgtctctactaaaaatacaaaaattaactgggcatggtggcacgtgcctgtaatcccagctactcaggaggctgaggcaggagaatcgcttgaacccaggaggcagaggttgcagtgagctgagatcacaccactgcactccagcttgggcgacaagagtgagacttcgtctcaaaacaaaaacaaaaacagacaaacaaaaacagtaaagtcttctttgattccctacgctccttttcattgttctccggagaaataacctctgaaatgatttggtatacattgtttccattttttagcatttacatatccatgttcctacattataattaaagtatccataaatcatactgagtatgaaaaagagaagaagggaattacatttaaattgtgtaatgcaaaaagtattggtggaattaagaagttttggaaattttgcataagatgaattggttctttattaaagatgttaagaataaagacataattagtgtgaacatttttataaaaggaggagcctatttaaaataattaatggaaatgattccatgtgatttgatatactttgatgaatgtcataaattaattaaagtggcttccagagagatctcccttaaaaattcattttaaattgaactttatactgtcactcactgcctataatatgtttgagtcatttatactcaaactttaatacaatccttgagtatggcaagaatttatgttgtaatgggttaaatttatcttgagaaatatttgttgaaaataagtatatggaaggaaggggttaggcatttagaagataaataaatatgctttgtactcttctctcctgaatctcataagccggttgttgatggctgttgtgaaaccttggttcttttctttaaacaagagacacacagcagaggagatgcagcatcgagtaatttattgcaaaagaaaaagaatattttgcaagttaagtgaggaatagacacttataccctgacagaattcagggtgggcttactagtaaggatgagacagcgtaaattggcactaggaagactccctttgtgggagttgtacatgatttttcataagtgggtgggaagaagtgttactagtaagcatattctaggttgtcctctgagtgaacatgtgcagtagctgtacatgcttgttcatatatcgcatgtctcataagtatctgaaatctccacccaggggtgtgtgttttactattataatgagcaaagggtcagtctgaggacaaggaaaatcaaaatgtgcatgctccccacgctacctgacttcaaactatactacaaagctacagtaaccaaaacagcatggtactggtaccaaaaaagagatataggccaatggaacagaacagagccctcagaaataatgccgcatatctacaaccatctgatctttgacaaacctgacaaaaacaagaaatggggaaacgattccctatttaataaatggtgctgggaaaactggctagccatatgtagaaagctgaaactggatcccttccttacaccttatacaaaaataaattcaagatggtttaaagacttaaatgttagacctaaaaccataaaaaccctagaagaaaacctaagcaatactattcaggacataggcataggcaaggccttcatgtctaaaacaccaaaagcagtggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatctagaatctacaatgaactccaacaaatttacaagaaagaaaaaacaaccccatcaaaaagtgggcaaaggatatgagcagacacttctcaaaagaagacatttatgcagccaacaggcacatgaaaaaatcctcatcatcattggccatcagagaaatgcaaatcaaaaccacaatgatataccatctcacaccagttagaatggcgatcattaaaaagtcaggaaacaacagatgctggagaggatgtggagaaataggaacacttttacactgttggtgggactgtaaactagttcaaccattgtggaagacagtgtggcgattcctcagggatctagaactagaaataccatttgacccagccatcctgttagtgggtatatacccaaaggattataaatcatgctgctataaagacacttgcacacctatgtttattgtggcactattcacaatagcaaagacttggaaccaacccaaatgtccaacaatgatagactggattaagaaaatgtggcacatatacaccatggaatactaagcagccataaaaaatgatgagttcatgtcctttgtagggacatggatggtactcagcaaagtatgccaaggacaaaaaaccaaacaccatatgttctcactcataagtgggaattgaacaatgagaacacatggacacaggaaggggaacatcacactctggggcctgttgtggggtggggggaggggggatagcatttggagatatacctaatgttaaatgacaagttactgggtgtagcacaccaacatggcacatgtatacatatgtaactaacctgcacgttgtgcacatctaccctaaaacttaaagtataattaaaaaaaaatgtgcatgctccatacaggggcaattccctactggagatagctttgcttaaatgagctggactacaatgcaaatgctgaaacttactatattgacagtaagattgccacagttgccgcgtcctgaggacatggttacttccttttaatacctatcctgtctcattgtgagaggattaacaactgtgcataaaaccagttgttctacatgagcacttaggagggataccagcattgtgaacatagtttaagtacgtagaggagggaacagttaagtttattcatggtgagtgttggtgaaaagtggaagaggtaccaaaacagccgtatagataactggttccagttagccaacattctctaaagttattagagaagcctaagtgaggtgtaacctcagcagtcgggagccaagagagcaagtaagtgctgtgatgtggagaaaatcactttgttccaactgagaagaaatggttgagcactgcttttcccccatgccagtactgacgcacagcctttcacttagcactgattatcgataggggtggggagttaaggtatggggaaacacaagtaacaatattttatttcaaaaacctctccactgtaattcccctaatccttcatcatggttgaggaaaatggctctaaaaaatgagagcaattactgtagctccaaaattctgtgattgcatgtcttactctgaatagcaattacaaagcatcagaggatttaggtccaaatattgcagacacaagaaaatgaattacattttaatacatctaaacttggagagcagagttccaaataaggtagaacttgagattcaactctgatttataaagcagagactaagaagagtatttataaagcgaatccatgtttggatacataaaagtgcaataaaattcaagctgaagttaaaatctctgtctagaacagcgatgttccatttatgcctgatccttttagcttttccacagatgaagactttgtcacctgttccagagagatatatttgttcattattgtttccagagagcaaaatggaaaataaactctgcacattttggccgcatctgtgttttatatgcggtgacactcctgttctcttcagtgaggaaatccagtaaagtaaaaccagtcttctgatgaaatgggcacaaatcaaagaacttgtgagcttcacaaaaaccttgaagcaaaatataccaagcttaaatattgaatgtattgatttcagtagtcaaaaacagagctcatctgcaaaagcaacaacaacaatgacaacaacaaattacatataagtaaaatttaaaaaaggtttacaggatgaatatacagaaaactatgaagcttaggggtagagaggagtagttgaatatatgaaaagatacatcttttttgatgaaggactaaatttttaaaaatgaaaattgatctatgtttatgaaccattagtaaaaataacaatagtattttctggaactaagtaagctagtgtaaaatttgtatgaaaaaattaatacatatgagtaatcaggagaattttaaaaaagagtgttgattcatatggcctaactccaaaagataatcaaatgtattatacaattttagtaattataatggtgtgatactggcactaggggagagagatcagtgccacagaagggtggctcaggaaatagactcaaataaaaatttgtaatgttatgatattcctcgactgcgggaggaaaatagattactcagttacttgtgttggaacaactaactcttcagccatttgggaaaagcaaagaaagctgaatatttatcttactccttttgccaaaacaaattacagatggatgagatttaaagtctataatgaaattggtatatgtacatattaaaagtttcaactataattgttattaacgtaaatgacaacggaacaccttgttggagggaaatttggtaatatctatcaaaattaaaatgccatgttttctgatcagcaatttcattctaagaatttttaatgtagatatacttgctcatgtacataaagattattagacatgaatgttcactgtggcatgattcgtaattaaaaatgtggcaacaaactaaatgcttacatggtaatcattcatgctgtttgccagatatttttatttctccaccttgtggtgattctggcatagtatttagtagttaggttgaagcatgtgactaattttggtcagggagttgtaaatggagggaatagctggtgagacatcttgcggaatactgtctcaggtaccatcgtacctgcagtgtttgagatagtagttgctccatcagtagaggtccctgagggactacaacaagcagagtcccctcctgacctgcaacacatatgtagcatgagcaataatggaacttattatttttgcaccctataaaattttgagaattgttactgcagcttaatttaatctttcctgacaatacaatacctatcaatagagactaatcagataaattataccatttccaaattgtatcatcctgcataaatattaaaaaacaatgaggtgagattcctaatgtgctgctatggaaaaatcttcaattttctatgtgtacgaatgtatttcccaggtattcgttttttccttcctgtatgttgacacattatgcacacttttggatgaaattaatatatttccaccgctttatgtcctctccctcacttttatcacccaattgtagcaaagtatatgtttgcttttatagctttagctatataaaattttctaatagctaagtttgtggttcctggaattaagatatctgaatttaaatctaacactactacctacagactatgcaccctggacaagtacttaatgtcttggttttgttatgtataaaatggagataataactgatttttcacttagagttgttgaatattttataagataattcatgaaaaagtgtcagtataatgcttggcacatagtatgcgctcaataaatgttaatgttattactattagatttaaaagtatcttttgacccctggctatagaagatgaggaaatcagagtatttgcacttctaatatctcctgttttcccacctacttttgttcaataaattaactccacattggcagggtagataatatttatattcagctttctaattatgctttctaagtttgtgtttatcttactcctaccgttatttggaagcagtcttcatctcaagtccttttgttactgttttttcactcatcttttagttgtctgaatttctttagaaaagtttaattccctgaatatttaatgtttatattttgttgttgtttttgcctttatatttggactcctaaaaaaagttttgttggttgtaaaatattgtttttttttccttgaagtgtttgtaggcatttcactgtgttctagtactgaatgttttagtggagaagtctgaggccagcttcatttgtttcttggatatttttgcccagtgctgaaaggattttttctcttgaaatccatccactttattagggtatatctcaatgttagtcctgggatatggtatcctcattctagctatacattcaacttttttcctggaaagttttcttgagttgcatctttatatacatatacatacacgaatacatatacatggtaaagatattaaggataaagataggtgctttataaataccaatttgatataattttggcatgaaaaaaagcctgtggtgcattctgagtttggaagtagaactggatatacttacttattactattgtttttaatacaaaaatggagacagggtctcactatgttgcccaggctggtctcaaactccttgactcaagcaatcctgcctcgacctcccaaagtgctgagattacaaatgtgagccaccgtgaccagcctaaatatctaaatttttctctttcattattttagctctcttctttggggctatcagtcatatgatgttggatctcttttgccttaatcttctaatttttcaaagactaatccagagaccactatctatcaccatgccattactcatagacaagggacatcattccacacatttagcttatttgtcaaaatcagagatgggatttataaaagaaaaagaataaagggagaaaacaaaacacaaattatctgggaatgcgagtctgttttcctttctttggctaatctacttacctagtagctaggaaagaggccagcatgagtatttttccattgagctggctagctcagtcattggagaaaccatttcaatatttatggattctctgaaaaaaacttggagagtaaaaaagcataggtggtaggatgctgccatccttctgttggcatctccagagtttcacttgaaaaacacctcctaagtagacactgataaattgattttaatccctatttgagcaccaatgcaatacattactatttcaagatggagcattagataactaaaggaaattctattgtgggcttgtaaatatcatgatagtcatacctatgtaatacatatatgtatatataaatattaatttttaaacatttacttagctattaaaaatcaaatgctcatatttaaaattattggtttattaatgcaccatcacatgttatcatgtgatactctgaattctctttttgcatagacaaatcagagattacctgctgcaagtcattagtcatcattaacctgtactgaaatggttagagcctaggggagttccaggtaaaaggaccagtaatgagtagaagcttgttagatgtagagatattgaggacagagataggtgctttataaatatcaatttgatataattttagcataaaaataagcctatgatgctctttgagcttgggagtagaagtggatatgtaattttcagggcgtagtataaaatggaaatgcacactccttgtttgaaaattattaacgattttacaagggtgacaacagagcattgaagcaagtgctctgtgagcatgaagccctgtgtgaaatacacacctgtgaagctggccttgcctgccaaacaggaatgctggtactgttaatcaaacagaaagttcagaatgacaatctgacttttttttgtagaagatactaaacttttggccttgaatatctgaatttaagatactggtatcaagccaaaagaaatttgggcttagaacttgaaagatttaaacttgtgctttgacttgtgtgctcacagctctctgtgtcacaatttttttcatctgtacttcgggacaacaatagtgtgtcgacatcacaaaggttttgggaggattaagtaggtgaatacatatgaagttcttaaaagaatgtctggcactgagtgagtgctacctcggttttggcatcgttattgtggtcattgctattgttattatgacttgaagtcatattagtgtatgaaatcccatccatgaatagaagacagaaagaactttgggcagggtttggaggtaaaagaagacattgtaaaggagatgggtaaaggaatgattttaaagactgagaataattaggggagtacgatgtcatggaaattaagggatgataagcaccaattaagttgttattggacttttttctttgaatggttcaaattcagaataataaggaaagaagtctgattatacgaaattaaagggtagggtgactgtggaggtagtgggagttgacttttctgctaataagtttagaaataaaggaaaaatggtagcttgaggaaagagaggagcgattaagggaaagtctctcgttaactcttgtttttcatctctgaggacagcgcttagcccaaggcctgacctgtgatcattactctctcaaggtttattccatggacagagctatctcatttcatgcttataacaaccctacattattagaattgttttagagatgaggaagctgagacacacaccaaaccagccttccaatttcactttgcacaactttgaatttctttatatttcttgaataaaagttccactttttaacttaccacttcttagcagtcattgtctaactgagtaattgttacttcattcatttaatggttctcagattcgcataatttgaacctaaatttaattggcctccaagctgatgtgcttacagaaacagtgacaggaaacaaaaatgtcaagggagactatgtattattaagatgataaatgaaatgatgtccaagctgagcaattaaagtgtgaagtagaaggacacagggtgagaaactgatgcttctcctcagcctctataaaaaagatactgaataaagataattgagaggcattaggggactagactgagaaaggattggaaatctgttcactgagagtacagaaatgaggaagcttggaaggcagaagattttggtcaaagacgtctggcttgaagctatttcagctctttggattatctgtggtggaggccatcacgtctttggagtggaggtaccatgaaactagtgtctgcaaaacatcatctaaatgaaagcaaaattcctgagaaggatggcactataatttttaaaagaaaagctatgagttaagcattcatatcaaggtagatgtttggagtgtattgcttgtgtgtgaaaaggcagagatgaccagaataagagttagaggtatgctgcgttttcttcttggttgatgagtaggatggcctggacaaagaagtgacctctagtaaaataccttcatagtgtcaaatcatctggaggaaattcagattaaagaggttggatgatgtcgtaattaagatcctgggcttttaaggtggacacatttatattcaagtcccaggcccaatgcatattagctctgttacttgagcttttatttctgcatctttaaagtttggcaaacctattacatgaagctgttgaggggataaatgaaataacgcatgcaaagcacttgcagtaaagactaattatcaatattttatttgttaagaggcagcattgcgttttactggtcaagtatgtagactctggggtgaaacatatttggtttggtttcatctctgcaatttatagtttgtgtagactttgagaatagttctcaatcattctaaccctcagtgaattcatcttctaatgggagtgatatcagtatggatttcatgagattatgaaaagaaaatgcctacaaagtatttattacaatgcctggcacagaacaagctctccttaattgtaaaaatgctaactcttattcttcataataaataaaagtaattaatgttatagaaaacaaaatcaaggatactgatttatatttggattacttgatttatattttgtcagtctataactggtcttaactaaggtaagtattaagatctcatttttaacagcgagtattcttttgattttagttcattggaaatcctgggattcagaaatgtggattaaaagtaatttcttctattgtacattttcctgatgcattagagatgttatccctggaaggtgctatggattcagtgcttcacacactgcagatgtatccagatgaccaaggtcagtacaatttgaattcaggatttagaatagatttttgtagggcattagctggtgactggatgtctttaaatatttttcttcagttttgagatttaaaacaattctttttttttattttcctagaaattcagtgtctgggtttaagtcttataggatacttgattacaaagaagaatgtgttcataggaactggacatctgctggcaaaaattctggtttccagcttataccgatttaaggatgttgctgaaatacagactaaagtatgtgcattatcttggaaagaatttgggaacttgtgcgaatttcacttttggagcagtttgtgtaattcccactttgcatgaatggggtattctagttaatggaaaaccatttatccttttgtagtattttaattatacaagcaaagaaaattggattgaatctctaaagatccagtgtttcattatgaaatctctaaagtcagcatggttattcaccatttatcttgcccataaaagttcagagaatgtgctaagaaatcccagctagctgagtttattcgcttagattttagataaatagaatttataaatattccaaagtttgtcactctctgggttttattgcaggttgcttacctttagtaattttgcttgttgatttttttccttgcagtgaaaaaatgtttttaacatttttcatcaagcaaaatttaaaacatgatatataataactgtctttgtaaggaattcaagatactggcctagagttagttcacgggagattaagaataaatttgttttgttttgttttttaattgtagcaaaacaaatagtttttcttcaagagtttctgccttggttgtggagtttgcaactttcataaactacaaaggaattttttttttttttttggagacagggtctcactctgtcacccaggctggagtgtagtggcagatttcagctcactacaacagctgcttcccgagctcaagtgattctcttgcctcagcctcctgagtagctcagactacaggcatgcactcccatgcctggctaatttttgtattttttgtagagatgaggtttcaccatatttcccaggctggtctcaaactccctggtctcaagcaatctgtcctgctcagcctcccaaagtgctgggattacaggtgtgagccaaggtgcccagctgactcaggaaatattttttgtaactggcagcattgaccaggaataaaaatacctggtctctaatctttgcacagacattatcagtaaatgagagaatatgtgtaaagttttttaaaaaattataaagttatgaacatacaaaattcttagattaataacaacaatgtgttttataactgcttttcataatgtgcctcaggctaggctgattaaaccaagataggattgattaaaagtaatcttagggaaagggaaggattttgtgccggtatggaactctcagttactctggattaattcatctaggcataaattttagaatctctatagtagagtttatgaactaaatctggcctgccaacatattttatttgtccagttcagggttttgctttgttttttgagacagagtctcactctgttgcccaggctgtagtgcagtggcgcagtctcagctcacatcaccctccgcctcctgggttcaagcaattctcctgcctcagcctccctagtagctaggactacaagtatgcaccaccatgctcagctaatgtttgtatttttagctgagatggggtttcgccgtgttggccaggctggtctcaaactcctgacctcaagtgattcactcacctcggactcccaaagtgttgggattacaggcatgagccactgcacccggccttcagttcagtgtttaaaagtttttaattcgaatgacgtactttctgcacatttgcatggcctgctctgctgtagcattcacttgttttcagagacctctgctctagaggcaggtggatcacctgtccctcagacatacataaattaaggctactttgcttatcaaatattagtattcgtagatactcagcatcataagagttcgaagtaataattttaatatttagatgacgtaagttaatttaaaatttttttgagatggggtctcactctatggcccaggctagagtgcagtggcacaatctcggttcactgcaacctctgcctcctgggcccatcctcctgggtgggctcaagtgatccacctcagcctcctgagtagctgggactacaggtgcatgcacgggtaattttaaaatattttttataggcacaagattttgccatattgtgcaggctggtcttgaattcctgggctcaagcaatcccacagtgctgagattacaggtgtgagccatggtgtctagccaattttattaatatgtaatattagaggtaataaaacattaaaaagttaagatgatccttggtggctttacccaacctaaataatactaaagtcaaaagcccaatctttcattaaaacatcacatgagtgaagaggacagactctggggatgtgcttaaggtggttctaaaaaagtaacggtgttctttataaataacttattattagaatgtaatcctcagagtgccctcagcgcttctcaactacactcaacataaatgaaatctaggagtccacactagcctttctgagataaacatttcggaagacagcgcaaaaagctgggggatatgctaggctctctagagaacctactgttcaatattataatacaaatttttactctattgacctgtttggatgtgtagttctgctgatccaaccgctttaatcctgtttaatatctgggtttcatcctataactatggctttagacaagcatctttgaaaaccaaatttgagggtattagttctttttcctgctttgctactgaatggtttgttaactagcattttattctctgtgcctgctatatttcttagtcatgagagagagagggagtatttatttacaggataaatactttaaagcaccaacccaatatatctatagttaaatgaacatcctaggtattgtttcatatacaaactctctctgctttatactgtttattcattttgcctgtaattgcttattttattattttttttcttatacttttagggatttcagacaatcttagcaatcctcaaattgtcagcatctttttctaagctgctggtgcatcattcatttgacttagtaatattccatcaaatgtcttccaatatcatggaacaaaaggatcaacaggtacagtgtttttcacttgcatcctaaatgttatgtatttatctgactctaattctcatttccactctttttagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtaaatattcaaggcctcacttttgtctttgctcagtattcttatagaatgtaagagccctgccattgtgtatctcttacttatatcatattattcttcactacagaaatttaccagtttattgcaattgtttgtgtcttgtagtagatttatagaattccagaagtaatagggtcctttaggtgttatccagtctaatctttcatttcatctgtttacttatcttgttaagttgataaataacttttcaaatgtgtcccttagtaggcatctctacaacttagtctccagatacactccacataacacatagttctaatgttttgataattttttaaccatttttttccatggttttagtttctttgcctagaaagttctcccctgagggctaccacacatggctatgcaggctgtggatggcacacttttgtcggtgccattcacagtgacatgagttgctgttggccaaagttgtgtaacactggtctttctttccttctctcttccctcctgaaccatgtaaacatatatctatctgattgttctgctctcccttcaaaatataattcaaattatctttctttaaagccctccccatacctccaaacctccaaacaaaattaagatttacttcttttgtcagtctatgaaaatatatacatatctcttgtatacttggtgagttgtgtgaaaataacagtgtacagtgttcatctttgtatcattcagaatatcgagctcattgctttacatatggtgtgtattcaataaatactaggttcattgcttatatttcagatttgtattatttgtataagtgttagagtttatactagcattcaggtagcactatgtctattttctagaaatttaatatttctaacaaagcaattatgtagtgatttaatacacattattaaataatcaataaagtactatgtttgccaatagtttactttttaaaccttactgtatttaatatccctactgtatttaatatcccacttgcctatggattgaaatcaatttgttgactgttaagattaagttaatactaattagtaatcaacataaaaagaaaaagaatttgtaacccattttcatgcattacgtttatgaattaaaatcacataaacaatctaattatttaaatttagtcaaatttcttttaagcaagcaacaattaaaatagttgctccgctttactaaagataattaaatttttccatcaataatttaatacatttttactgtgcatcttttgcatgcagattattgcattaattttaattgaaaataccgaagaactaaaaagaaacttccccttctaagtccacattaaggaaacaacatacctaaaagcacctgatacaactgtactacattccccacaggaaatcatttctactattctttcaatttatccaaatctttctacccaacaggatttttactttattcctctttccatattcttttggacttcatatgcttagttttatcttttctttttaaaacgaaatcttaaatccaaggattatgtattaggtttaaagaatttatcccagttgtcagaggttatttatatctagcaaacaataactgctgattaaatcttgtggatgagtttgtcgtatgtaccttatttgtgccagagcaaaataaggtaatcaggactatttattcatttaccaagaggttacatattgaaggactatctagagcaagggtggagttgtgttagactttctgcagagaatttgataatggaatgtacatgattggtagagaagaatatggaagtttaatactgggtatgcaaatgcatggataaaaacctcaaggtaaaactcatcaaatcacagtggaaaaagtatagtgaagtctgaataaaaataataagaggctgggcatggtggctcacatctgtaatcccaacactttgggatgttgaggtgggaggatcacttgagccaggagttcgagaccaacttgagaaacatagtgagactccatttctacaaaacaaaccaacaagcaaaaaaccatgtatgatggcacacacatgtagtcctagcttcatgcagggtggctcatgcctgtaatcccagggctttgggaagtcaaggcgggaggatcatttgagcccaggagttcaagaccagcctgggcaacatagttagacccccatgtctacaaaaagtcaaaaaattagctgggtatggtggtacctgcttatagtcccagctacttgggagtctgaggtgggaggatgacttgagcctgggaggttgaggctgcagttagctgagattgcaccattgcactccagcctaggcaacagagccagaccctgttaaaataaaataaaataaaataaaataaaataaaataaaataatataataaggctgaggtgggaggatcacttgagcctaggaggtcaaggctgcaggagctaagattgtgccactgtacagcagccttggtgacagagggagactctgtctcaaaaccaaccggtcgggtgcggtggctcacgcctgtaatcccagcactttgggaggccgaggtgggtggatcatgaggtcaggagatcgagaccatcctggctaacccggtgaaaccttgtttctactaaaaaaatacaaaaaattagccaggcgtggtggcaggtgcctgtagtcccagctacttgggaggctgaggcaggagaatggcgtgaacctggaaggcggagcttgcagtgagcctagatcgcgccactgcactgcagcctgggcgacagagtgagactccgtctcaaaaaaaaaaaaaacaaaaaacgaaccaaccaaccaaccaacaaaacaaacaaacaaaaaaccaacaaaaccaaacacttctatcatgctcattaccacctgggcactgctccaaatactttacacaatttaatccttacgacaacctacgaaaaggtccagtaggttctaatgttattcccattgtgcaagtgagaagctgaggcactgagggtttaaataacttgcctaagaacaagctcctggtaacagtgtgaaatctgcctccacagtgcctgctttaatttcttggctacacagcagattcatggtagtggtggtagtggtgttcattttctctaaaataacagtttgaataatttggttttgataatgcactgcatttattataaattagatgatcagagaaagattgcagggataagaaattatgcttttgataatctttagttatattcttaattttcttcattattatttaaatgtaaaaataaatatctgtgagcagtagtattttcctgtcatgaagctgaaattactttcataaatatgtgtgaatattctaaagagaatgactctgtaggatttaaagaaattaattcttatttttgctggcatttatttattttatcagattcactttctcatatatgtctctcttcatggcaccatatgcctaaagtcagcttggatagtttggatcctccaaggaaaattccttccacaaacatgtgcagcacacagtgctagataattaatagagaatataaaatgggtttcctgtttcaagatggtttgtaggtctgtatgtgtagggcattgacaagagagtaaaacataaatcaccttagtacaaagtaaggagtgaatggcatatcttagagaaaaaaaagttactgggctataagagaaggcatttgtgagtttttccctccctccccgcttcccttcccttcccttcccttcccttcccttcccttcccttcccttcccttcccttcccttcccttcccttcccttctcttccctcccctccccttctcttccctcccctcccctcccctcccctcccctcccttctcctttctcttccccttccccttcctcttccccttccccttctccttccttccttccttccttcctcttccacctgccttccttttaattttgctatgagcccttaaagaggattttagtaatttgctacttaaattaaatatatttgctagatgttgtgctaggcttcaggaatacaagttggattgcagtaatgtaaagccctttgcattctagcaagaaaacagatgggtatgtatgtttgctcagtgctacattaaatgaaatggatgggagccgggaggagaaatggtgtgtttggcctgagaggttagtagcaaggacttctctgcaagaaagtttgaagccaattcttcaagaatgaacacctttttgctgggtgaaaagtagaggaaggcatttggggtaatagaaatagcataaaaggtaatgaggtttgaaaaattacatgctgtgtttggaagaatgtcctggagcagcagcgttttagaaggtttttaaagacgatggtgacttgatcagagctctgtagtgctttgaggatgggttgaaggtgggcgtacttggagactggtgggcatttaattggtgccttccaaccacataaatgaatgtcccctcaaatcccttggaaacactttaattctagaaaattcaaaaattgtccccaacatctttttcctctgagttggtaccctggatctttgggtcttcttttctttccttttttgatgttttattttgggtaatgaaagtcacacaggttttgaagccagcagatttggcttcaaatccaagtctcagttgcttgctagctgtaagggacaaattatatatcttttctaaatactcatctataaaatgggagtaataattgctatggcataggatttttttaaaaaaaagattagaaatcatgtgtgtacagaatttagcacagtaactgatggatattatttctattacctgttatcttggtcttctagttgatagctccttgctagcgtctagctcctttccatagctcttcctgagtagggccagcatgcagtgccacagcttgctaaggcttctcctggattgctgagttgttctagtttttgtggcacctcacatgctaacccaccctgaacacatgctctgaaaacataacatttagaggaaggttgaagactgagagacaaggtatatctttgaggaaattcagatgcttgtcttgaggagctcaggaaagctagacacgagtaatgactgtcgtttgtgtgtggcattaataaattttacaatagctatgtccccatttagttattctatgtcacaaataaaggcaggacagtagtatttactgtgttaaggtactggtttcccaggtatcttacagtgagaagacagaagctcagaaagtgtaagcaatgtgcatatttggtggagtctggatgtaaacagagatcttgatgccaagcctgtggagctttgtctccatataatgttgtctctttcataataactgactgtcatgtggcagattattcatgctattctgacattgatggcattaatatcatcttattttcccaatctattcaaggatcagttttgccttattttattttgtttcattccaaattggagatgtagagaaaaatcacatgaagtttgatttgccagtctcctaaaaggaagaaaaatgtagatttttaatatacttaattttttttctttaataggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaagtaagtaacaaggagaatattttttacaattcttatttttaatagtatttttttaagtcactagtcttttagtggttattcatgccagtttgagggaccttaagccaaagatattgcaaaggtttggattttttttttttttggctatgaaatacttcaaaatgacatttaagttctttatgagatagcaaatagttatttataaaaatagagcaaaatagtggaagctttttgaaggggtactttttaatatatattttttattattaaagtaagatatccctgtttttaaaggaaatataaaattataaaaaagaaaataaaaataacttattttatctcttataagtaattaatatggatatttttcctaactttttatatgcttacatgtacctatgcattcaaatgtatgtaaaagcatacacacatatttatttggcatttttaacttagaatatactttatatttcaattgataatgcattttctttatactttcaagctcatgtgtattttgtacatattatgtgtattgatggtaagttaccatcttctgacactatttttatcttttgagctctctcatttgttcacactaaatgtgtttttagcgtgaaagctcccagctttccctgtgttaacttagtcccatgcccatctccttccccatggtcatcaaactccatgaatcaacaccttaaggaccatcttgcaagtaacatgtttgcttctctcatttttatgatgcactcactagcaaaacaccagttttggtcagtctaccagtctactttttccctcagtttcaccaagaaaactgagtgctgctagagaaaagtacccatccatgcaatttggtgcctttatacatcaaggtttccaaccgctcagtaggctccaaaagttccaatcaggctgaattttcctcggtttctcaaacacttcgtgtacccttacttccagtctttttccagtgttactctctctctacctagctctaaattctctcttcacctggctgtctcttcattcttcctgtctcagtgctatcaccagtctggaaggttctcttacatgaccctatagcactttatttctcacatatactaccattcaccacattatataatttaatttttcatttttataatctactttttggtaaattgttagtaccatgaagtcaatgtcaattttgttcatggttgtaaccttaccattgatactagtgttttgcacatagtagattatcatttagaattaagtattcaatattggcaaaaaataaaaattgtgtaatacattatgttgataagcatgtgtggaaacatgcttcatatattgatatgaatttaaattgtcctcttttgaggacaatttggcaatatctactaatatttttaatatatgtacatacttttttgacctcacaatgtactgttaggaatctatgatacagacattctcaatgtgcacaaaaattatgtacaaaaatgcacattaaaacattgtttataatagcaaaagagtaggaaaaaaacctaagtattccccaaaaggaactattcaaataaataatggtacatacatgttgtggaatgctttgcaatcattgaggaaaaaaaaacgtggagcaaatttaatgtcctgataaagattacattactccgtggcaaaaaaaagggcacagacagtgtttttactatgctaatgttgatgaaaatgcaactggaatatgatagttataaaagtttgaatatgaaataaaaccctccagaaatgggttccctggttgtctctgggtctttggaaattactgagacatggttagatcccatgtttcattacttaaactagtcttatgccaaaaacctgcttactttaatcttcaatatccgatggagaggaattgtgggcccattggagagggacagagggagatttatcattcactatattctctttgttctgtctggagtttttaccattgacacatcttacccagttaaaaaaacatagaattgtcatttgattaattggagggtataaccatgatttcactggcagctggtctgagtaaagaacactttgggtcatagctttcaaacatttttcaggtagtatttgcctaagtgacatatttgtgtgtgagctcatcctaccgggcttcgggataatttcccatatcataacatattactctggaaaaaggaaccatttgggtatatgggtatagtgtaagccatagtatcagttgccttcttggggtttatcatatgggtccaccacatatttacagtaggaatagatgtagatacatgagcatacttcactctgctactataattattgctattcctactgttgtcaaagtcttttagctgattatctacacttcacaggggtaatatcaaatgatcccccaccatgctctgagccccagggtttattttcctttttacagtaggaggcctaaccagcattgtattagccaactcatcactggatattgtactacatgatacagcagtatcatgtagtaatatttgaagtcattacagtagtaatatttgaagaaatcttcctggctgtatgtagaacaatgaggactcagccaacttattcttcatagtagagctaatacataatgtaatgaagttgtgagaagaatgttaactttgaaattccatcaggtttcccaatagtcataatgaatcactcagcaaactttataaaaataacaagatcctttatttagcagtttatgtgttctatgcattgtgctaaacattttatatgcatcatttcaattactctttttcatcaccatatactgtatttattatcatcttcattttccaggtgaggacactgatacccagggagctcatataactcacaaatggcatttctatgacttgaacacaggcctgtctggcttcaaagcctaggccttttcctgaataaagttagttccatagagattcagttttgctgtctacatgaaagcattgtgtacatggttatgtttttttaaaaaatatatgatctgccacctgttaattattcaggatcactagtgtaaggtgactttgaaaggaaaaatagaaatattctccagaagcatagcaatacgtaagaactttggtcctatgtatgtttatttttgcataattgttgatttctaagttgctggtgtatctcttattttcagatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggtatttattataaaaaaaaaccctttatgctttatatttacacactgacattgaacaataggacccaagacaaaaacctgacctaaatcatctggaaaaacttgagtagaaatgtgtttattatcgcaaacagttaagtttactaattttggttaaagtgatgggtcaaggaagtgtgtctctgtgcttctaaatgttatactaattggttaatggttaatattccaggaaacaaactctgactagactggaacgagattccacgctctgtcattgactagatcctttcgtggcttgtgtaagccccttaaccttgttaaaggtagtaatgtcgactttgcagggttatacataataattagaaaaaatgtatgtaaaatgtctgcaacaatgcttggcaaacaggaagcgcttaataaaaaaggtttttatctttactatagcttaaaacaatattaatattttaatagctcacttgagataactttttaaaaaattaatatggtgaaatatataatgacaatgattagggctgatgtatttagcattagcagtttggtaaaaatggagtgaggggctttcttattaatatagtatgattgaaaacactgggtgatagaataaggatatttgagagggcaaaaaatgagagttgttccaaaatattgtgtctcaagtcaaaccatttttaaaaatcaagtgtagtgatttatatacatatataatttatataaaataaaatgcattcactttaagtatatattttcatgcgctttgaaaattaacatattcatgtggtcattgtcgctattaagttatgcaatattttcattatccaaaaaagtttcttcatgcctcttcactgaaaacatccccttcccctggcccccctgacccttagcaatcatttgcttcctgacaatgtagattaatgttttctctagttttatatacataggatcatacagtgagtactcttttgtgtctgttttccaaaatgattgtactatgttctacccccaccagcagtacatgagcattctggttgctctacatccttgtcagtacttggtattttcaagttacttttagctgttctagtggaggtttaattcatttagatgtaattttcatttccctgatgactaattatgtagaggatgttttcatgttcttattggccattcttatttttgtgtgaagtgttgaagtattttgcttttaattgggttgtcttattatataagagttctttgtatattctagatagaagttgtgacaggtatatgtattgcatatttttttcccagtcatagcttgtcttttcattttactaattctatttttaacaaaacagaggttttaaatcttggtgaaatgcagttttccagtttttttcttttatggtttgtgctttttgtatcccacttaagaaaccttttcttagcctaaatttgtgaatattttctcccatattttctcttagaagtgttaaaatctcagctttggcatttaggtctaaaacattttaagttgatttttgtgtgtggtgtgtcaatgaagagttgacatttatttctttctgtatggatatccagttgttccaacattacttgttgaaaatattatataattcctcattgaattaatggaagctttgttctctttaattgactatttaggtatggttctattttagcattatttattctgtgccactgatttataccttattcttatgccaataccacactgtcttgattactctagcttaatagcagttcttgaaatcagatagtgtaagtcctctggtgttcttttaaaaaaaattgttcttattattctaggttctttgcatttccatataaatttttaatcaactaactttatgctgggatttttattgtaattaagtccatatttagattttatatagaatttatttataaattaaatcatattacctatgattttaatgtaatctataatatataattaatacataaataataatttatatagattatatctataaattaatttgagggaactaatatattaataatgagtcttttgacatattaatgtgatatatagttcaattagtcttttaaaatttctaacagtgtgttgtattggatgttttctgatactattatagatggtattgtatttgaattctaatttccagtagttcactgttgatatatagaaacataattcatttatttgtacatgaattttgtatcctgtaaacttactaagctcacttacgtgttccagtaccttattatagattctacaggattttctttgttcacaattataccatttggtaataaagacagatttgctttttcttttctaatatttatgtcttctttttttttcttgtcctattgcactggctaggacctccagtactatgttgaatagaattggtcagactgggcatcattccctggtttccaaacttagaggaaaaacatacagtctctaatcactaattatgacattatctgtagtttttcatagatgcccttcatcaaattgaagaagcttcttcctagtcatttttggagagcctttttttatcattaataggtgttgaaaaatgctcttcagcatctgctgaggtattcatatttttcacctttattttgttaatatggtcaaatacactgactgattttctaatgttaaaccaacttgcattcctggagtaaatctcacttggttatggtacattatcctttttatatagtattaaattttgttttctaaattttgttaagaattttgcatctgtgagagatattagtctgtagttttatacttccttgtaattatgggagtaatgctggcctcttgaaatgaattgggaagtgtttcccattccacaattttctggaagaatttgtgtaaaggtattttcttcttaaatgtctgatagacttcaccagcaaaggccatctaggttttaaatttttgtgaggaggagatttagaattatgaatttaataactttgatagatgtatgattattttaattttcttttacttcttaagtcagttttagtaatgtgtaactttcaaggaatatgcccatttcatataagttgccaaatttatttgtttaatgttacttatagcaattatttaattatcctgttagtgatttaattatcctgttaatctcttcaaagaatcagatttttgttatattgattttctctattgtttgtgttactttctcacggacttttgttcttatctttattgttcccttttccttacttatttttattttaattgactctttttatagattcttaatttggaagcttagaacactggtttttagaaccttcttattttgtaacagaaacatttatttaaggctgtatatgtccttataaatatcactttcactgcatcccaatattttgatgtgtcctctttctattcatttaaaaaaatttaatttcccaaatgtccaacaatgatagactggattaagaaaatgtggcacatgtacaccatggaatactatgcagccataaaaaatgatgagttcatgtcctttgtagggacatggatgaagctggaaaccatcgttctcagcaaactattgcaaggacaaaaaaccaaacaccgcatgttctcactcataggtgggaattgaacaatgagaacacttggacacaggaaggggaacatcacacaccagggcctgttgtggggtggggggaagggggagggatagcattaggagatacacctaatgtaaatgaggagttaatgggtgcagcacaccagcatggcacatgtatacatatgtaacaaacctgcatgttgtgcatgtgtaccctagaacttaaagtataataaaatatatatatatatatataaatttaatttcctttgtgacttctttgattcacgagttatttagaaggctgtcatttattttccaaatatttggagattttctggataactttctggttattggtttcagtttgacttttttgtgctcagataacctactctgatgatttctatccttttatatttattgaaacatgctttatggattatcatatggtctgtcttggtgatgtgccatgtgcaactgaaaagaaagtatattcagctgttattgggtcaaatcaataggccaaattgtttggtaggatttctcaagttttctgtgacttcactgacttttctttctatttattgtatttgatagagaaatattgaagttgtaattgaggatttgttggttgccttttcagttttatctgtttatgctttgtatattttgaagctctgttgtttgttgtgcaaacattaaggactatataacaaaggactatatataaaaataattttttaaataaagtaaccactttatattaatctaagtttgcagttagtatcattttcttcctctggaagaattcccttttacatttctagcgcagatcttccagaaacccatatgcagattactggagcactttttccataactgccccagaactcccagctatctcagtctccataaatgttgatctctatctcctcatctcaggaaagccatgagactgtttaaatttcttcttatgtatatggcccttaatttgtctctaagcagaaggccagagtgatcatagggctcacataatttgtttcccttctttcgggtattacatagtcctatgctgtctgttgcccagtgtctgtatccagtcatttaatatatttatccagttttcttgttgtttatgtgagtaggttaagttcacatttgttactctatcatgcctgaaagaactctcttcaagtatttttcaagaaaacattagaaattttaacataaaataattataaaatgcactatgctgcttgtacaaataatgtgctaatagacatttcacacacatataaagtgggataattatgataatttaataatctttataattatgtaattgttactaaattataaattatattttattaaaattcttaagcattaaaataatttaaactatagaattaattaaactttagcaatgaaccaggcaggaactgtttatatcaggatttatactgaatattataagggtggtatttggatatacagattttataatttggttttgacataaaatgaattctttctttttctaagataaagagtaggggaatttaaaatcataattaatttttcacaaatgcattcacattatttatctttaatatgatttttttattgatctttgttttcttgtaaatttattattttgaaagtactgccttttccttattttataaaacaattattgccagccaaatttattgtgtttattttaataccattccataaaagaaaccatgaaacatgaaattcaaatagaaatttattaaaaattgctgactgttaaataatttgtgtgattacaacatttaaagcaagatttgaaaaatttataagaaaaattcagggagttaatccactctctttcctatgctgctagaccctattccagcggtctccataaaaaaaattcagagaaacagaaagcagtaacagtgatcagattgcatacaaactttctgcacacacatatatttgttataacttatgtaaccgttgattgatttggctttttcctgctggactatgagctcctctgaggaatagatttattttttttctgcatatcagtatcccgtgcttacccagtgtctagtctgtaacagccattctataaatatttatgggtgaagaaaaatgttgttgaatttttaaagtgaaaaaccaacatggcttatcatctctattttaaagattttacaaagggaatggactgtgaaatttccattaataaaaataggtctaatcttccatgattgaactatgatagaaggatcttatgattgagtaagctttttgtattcaccttcatgttattttatcattttcaaaataggaagtgaaggctcatttcttgtgaaaaagaaatctaattcaattagtgtaggagaattttaccgagatgccgtattacagcgttgctcaccaaatttgcaaagacattccaattccttggtaagttaaattgtgcaattgtgattatgttgtgttttgctgctgacattctcttgataactaaaatttatgccaaagctaggaacaattggtagggatttccctgatgtatgaaaactataattttgagatttttatatatgtaatagatatgaaaacatattagatgtaaattatgctcaattcacatttgtagtcttttgagtatgcagggtatgaattttttggggcacatatatatatatatatatacttacagtacacttcaagatggttttcttctttcttttcagaactccatgtctgaaaagagcccaggctagacctctacctaatggtgtgggttggtcccatgaacactttagctagaaatctgatagtgatttctaagaaaccagacagaagtctgaaggacactgaacaagatggagtagcataatataattcattgttcatctatctatctatcatctatctatctatctatctatctatctatctatctatctatctatcatctatctatcaatcatctatctattttggtgtattgaaagtcatttaattttttagatacctttattattatttcaacctcttgtctgttttggaactatggaaggactatggcatatttgcatgaggagtctgataattctagttgaggaaattgggagccaccttattctcaggttcactttgaaagacctgttctaacctattctccaattttgattatagctgagtactaaaaatatgagggttgttttgtgttaattctagatcttaagatgggtgaaatgaatgactgtagttgaatcggttaaattagctgtcagtctttatatgctctttcgaatttatatataaatttagttataaaaagtagtttggttaatgagaaattatatggatatagctttttcactcaacctttctgtttttcagtttccttatatttaaaacaaaggagaaagagtagatgctttctaaggtcatttgagcactgaactggagttttcttttatcctcataattgggttcttagtttttacttgcctattttttcccataattataaataccattaaccctattaaaatttcatggttccttccttataaaaatgtcctcttctccaataaatgacagcaattttattataaattattttttaataggggcccatttttgatcatgaagatttactgaagcgaaaaagaaaaatattatcttcagatgattcactcagtaagtatttggatgtaatcataagtaaatagatattttgggcagaatgcagtgtttggttgaatttcctccaattattcaaatattcttggtgccagtttcatcttacataatcttcatatatatttacctaatgattccttccataagctatagaaaaatgaaacatacatttaaaaatttacctttcttgaatattatagaacacattagtctttttttttacaagttttctgaaatgtaaataacacctccaccaaggccactcttcatcctctcctccagttttctttctttcttttttttttcacaccacttacaccacctgattaaatgctttttatttactgttcatctctgccactggaatgtaaactccatagtttggttttctactgaatcttcagtgccttgaagaaagcctgattgctaggaggtgctcactaaacttttactacatgaatttaaattatttgcttatatttccattgtttgtttgtttttgacaaaagggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaagtaaatttaatttatccttgtaactttcaagacatttgaagagcttttgtatttatatctaatttgcataattaagtcgtttaaaagaacattctacttttgtgtcactgggtgataagtcccccgtgcctctggtttttgcacacatatcttagtctgtgtgatgttcaggagcatctttgagggcaggcaatggaaacagatctgattagaaaggaattccaggttctgtacggagtacatgttaaagtctgtcaagtgtatattgattatactttaatcatttaattcaagtaagacaacttcaacaatttaaattagattaggtaaactagaattagacctggtttggtagtactggctctgactcagctaccaactgtgtgacaatatgaacatgtcactccgcctgctctaatccttcattttctcatctgtgaaatagagattcaactaaatgattactgaaagtttttttttcagtttaaaataatgtgtaacttaaagatttttttctttttggtcaaagttcctgtcttgtaagaattaaagtataacatagtttgttgataggatagctctctgaaaattgactttgctcaccatttgtatgtactacagatcaaaatagttttgaaagccaaagaagatatcataaaagttaaaattattttaatgcaaatgtttaaattgttaaattctcaaggctgggcatggtgactcatgcctataatcccagcactttgggaggctgaggcgggtggatctttttgagttcaggagttcaagaccagcttaagcatcagcaaaatcctgtctctaccaaaaatatgaaaaattagccaggtgtggtggggtgcacctgtggtcccagctacttgggatgctgaggtgggaggattgcctgatcctgggaggcagaggttgcagtgagccaagatcgcaccactgtactctagcctgggcaacagagtgagaccctgtctcaaaaaaaaaaaagtcttgttgcaaatgcatttccccctttttaagcctaaaaaattaatcataattttgagatgttttaaaggcaacattacataaattttaagtatatttaagggatgttttttctctaaagtttttatatctggagacagagagaagaaagaaaggtgacccactcctccagccatgccctaatgtctaaaatgtgtctttctctcttctccacttctttgccttgctaaatacttcaagccacccagggctcaatttaactgtcacttcatcactctctgcttctcttcctttttccttctaccctccagccaacctacccacctagcctccatgtccataacacctgatgctttccacctaattctcattcggtcatccaatttgatttaaaatacctttgcccccactagactgtgaactctttgaggacaggacttgtttcaggcttgtttctgtctattcccagtgcctagtgagatctgacatatggtagaagtttagtacttactgaattgatttgtggaggaataaatgtctgaaacttggtaatccttcaattaatatttgttaaatgagcaagcaaaataattttgggatttagtctagttaaaacaaagagaattggaagagactgtgacaaggtgagacatgccggcattcaatgactggacaagctcagaaccttctcttagggaaatttcaaaatgacaccattagatggcactttgtttgtttgtttgttattgtcaaagggtctcatctatgttccttttataggaacatttcctgattaaaccttgggaataattttaaaatctttacttcagaataagttaatgagggtctgaaacaaaagcaggaattttgaaacaacttctggggctaagagtggttaataagcctctataatgatatcaaactctagagtttctcgtgtggataaatatattgataaataaagaagaccatagagaagtgattgattttggtattttagctctttgagagtattacgtacctaagttttaaaaaattgacataatgtgtaagtaggggtttgctattatcattataaaattagaaattgcttaaaaatagaaagtagaaatttgaaacaaaaagtttcgtaaaaaacaggaggttctaaaatgaaacacattataagtaactatttttatagttaaatcttaaatatatcaaaatatgtaaaatttctgacagcatttaaaacatattcccaggattatattgtactttttgttaaatcattaattcaaatatttgttgaggcgtattctgcttccattttgctctttctggaaataatttacaaaaaagctgaaggaagctttcaactctatttttgtgaacctgctttttacaatctacctgttgtaattttcctggttttacccatgctacaagcagagacgattgggccaattagtatactgaaattctgttgtggattgtgttttcaactttttgaaaattcttgatggttctagttaccagaggtgtgtaaggcagaaatattagctagacttaagttcctcagatggttcactttagaattttaaactattgtcttttcagactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaagggtaagaaagagctcattaaaaataaaagggttgcctaaatatgctgatgttaacaaaatatgctgacatttttatagcaatgagttttaacaacatggtgaaactccatctctactaaaaatacaaaaattagcccagcgtggtggtgcgcaccttataatcccagctactcagaggctgaggcatgagaatcgcttgaacccaggaggcggaggtcgcagtgagccgagatcgtgccattgcactccagcctgggtgacagaggcgagactctgtctcaaagaaatatatatatatatatatataatatatgtattataatatataatacatatattatatatatttattatatataatacctatatattatatatatactatatataatacttattatatatatactatatataatacttattatatatataataaaagaccgaggcaatgaatattacaacttttatcaactgacttacatttttacaactaatttttaaattaatgagtcctctttgatgctgttctttgaaagcaaattgtttttgatattttttctttaaagcatatgaatttatgcaatttaatcattatcttgtctcttgtgactagaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttggtaagtgttctgtgtgggtctcctccttaccaggccctctaagttgtacaagatgagtcatatatggaccctttagttgtggatttaaaagtggcatttcagtttaaatattatgctggatttaaaaaataaaattagcaggttggcaataaaacaaaatgctataaaactatgaaaagacatgaaagaaacataaatgcatattggtaagtgaaagaagccaatctgaaaaggctacatactattcgttcccaactataagacattctggaagagacaaaattatgaggacattaaaaagatcaatggttgtcaggggttaggggagggagagatgaatagataaaggacagaggatttttagggcagtgaaactgttttgtatactatagagggggatatgtgccatggtacacttgtcaaaacccatagaatgtgcagtataaagaatgaaccctgatgtaaactatggactttgagtgataatggtgtgtcaaatattggctcattgattggaacaactgtgccaaactaatgcaaattgttaataataggggaaaatgtgtgtggggtggtggtggtggtgagggaagaagggatttattgaaagtctctggactgtgtgctcaattttcctgtgtatctaaagctgccctaaaaatagtctataatttaaaaaaattatcacatttttattgtcagaggttaaaatgatagttacttggcctactgtgtagtaccctgtggttccctttagtcttaaactaaacatgcacatggctgcctgagctgggtaaggcatcctgatactgagatattgtttttcatactgaagtttcttcagcaactttttgtatgataaatatgattactctttgctgttgttagaaataaaattaatcatttaatggttttcaaattagtgaagttaatgtatattcattcagctcttgtgctttgcaagacattataataatgcaaattattatcatcacttttattaaaagttgtagaatcccctgccttctcttagcatatgaaataatagaggaaattatgttcatttgtatcctaaatgaacattttaattttaaggaacaaaatacttttatgacaataaacaggaattccccatattttatcttccttcatagagaatactcacatcttgccacccatgtgtttattctatacctgactcagtaaaataatttttaattctatttaatagcagaatatggcttaactacttattaatagtattttaatttgtcagagctttcagaaactaataatgatcaaagccatcttaatttggatagtattttcctccttttccgcgccctcccttcctcctaccctcctgaatattggccactttccaaccatgatcttgaaactggggatagagttgttgactcactcactagtaagcaaagcaaactcggtctctgtccttaaggaacttgtgattaagttcagagcacagacaaacattaagtaatgatggcataaataaatgtaattttatattgtggtgccttctgtggaaaagtttcaggatgctctgtggtacctcaggggaatctgattcagactgtggagtcaggaaagcatttctgtgcctgtgacatttaagttgggtctggaaagaggagcatccaaaaggaccttgaagcttgtgtatggtcagtgtgtcatctcagctgaatctcacaatgatcctaatggtcatacctaggacaggtatgacctctgcccaattgaggaaattgaagccgtgagattttttgtgtgatgcttacaggtgcatacaattaattatcttgttgtgaaagtttgaatggaccccagttcaaaatctgtttgctttgcactacacaatcttaatagtttgagaagtggtcttacatttgagaagatgccccatggaggtgacatctgagcaggaccactaaccattaaaaaataatcccatgtaaatggtgaaaccctgtctctactaaaaatacaaaaattagctgggtgtggtggcgtgtgactataatcccagctactcgggaggctgaggcagaagaatcgcttgaaccagggagtcagaggttgcagtgagtggagatcaggccacagcactccagcctggcgacagagcaagactccgtcaatcaatcaatcaaacaatcaataaatcccatgtaaaataaagttttagttctgtggccttatgagtgttttccatacagcatatgaaactcaagactctgaagtcttaagtggagaatcatttcgattcatttattttgcgaataggtgaggtataatagctatctttctgcttctcaggaagacagcttctaggagtgtcctggaacattttgacccttgaagattgtctagataaagaataacccatatttttaaccttgaaaatgctaataactaattcctcaatccgttttcctagaaacggtagatttgtagatctctcaagtgtcttagtgttcatctgatctagctacactcttttacagataagaaaagagactgtgtgattttctgtttcccaaattgtgtttcacagaattttatttcttggaggtacctcatactgcatttccttcttaacaattcataaagtaggccaggcacggtggctcatgcctgtaatcccagcactttgggaggccggggcgggcagatcacaaggtcaggagatggagaccatcctggctaacatggtgaaaccccatctctactaaaaatacagaaaattagctggacatgatggcacctgcctgtaatcccagctactcaggaggctgaggcaggagaatctcttgaacctgggaggcggagattgcattgagctgagatcacgctactgcactccagcctgggcaacagagcgagactctgtctcaaataacaataataataataaaataataaaaaataaaaaaatcataaaatataccagagtattgagaactcagatattttactttattttactgaatgtttcccaatctcttaagattatatgatcgaagaatacttttattaaataacacccattattattccatagaacactctttatgagctagtaccataaagaatttttgtccttataatatactgtattttagtaaagtgttcatagttgttttgctatagttatttaagagtaattctagttaatctatatggtatataataacatcacacataatttgaaatgaatattctaggaatttttactttgtacaaatgttgggtagacaaatttatatttaaatagctgtttagcttccaggttaaaaggttctggtaagtatagcatattattttattgtttagtggaagtattaaggctattaccttatttttaaaagtggatttttaaaaattgtcagtgtgagaatggaaatcaaattaagtgacacactattggtagctgttcttatttttgaatttaatggaaatctggttaaaatgattaaaatgtttatctcattttttttcttttagctgctatgcctttcttgcctccttctatgacaatcctaaaattatctcagaacaaattttcctgtattccagaagcaattttaaatcttccacagtaagtttattgttattttaattttaaaagcacattagctggaacagaacctttagaaacatgatttcgatttagtcatatagaggtaattgatttctaaacctactcaacttgatgtttttgtatgtatgaatgattttcactagataaaagacccaactcattacttaaaatggaaacttttatatttatttagtggatcattgtgtaaaaacaacttaagattgtttaattaattgctgtattagtataatgaaatgagattatactggctatcactttaacttttaaaattttaattgtttgtggaacttgatatgttgccaaaatacccttaactttcacattatgcttaagttatgtttgagtgaaattttgggggaagattaggcaagtttatgtagttccaggtttttgagatattttggttaattcatgaaaccagaagcttcctgttaactttaaattcaggcattaattggatcttgagtgtgttgtaatcttaaatgctattctaattatatcatacatgataaaccaaattcataaaaatatatgtgtaaatttatcttttcctttgttttcttgctgtcagctattccttcaaacactatggctttttagaattgacactaaaatgctgcttgcatgatgctgcaatgagctcttctgtgagcttatatttaggcaaataataattagaatttagccatagagagtgttacacaaacctataatagctaaattacgtctagctttagaatgtgtttaactgttctaactactctacagcggttcatctctttaatcttcctaataatgccctacgatagccactgttattatctccacttcataagagatgaagtaacttgcccagagtcatagttcttaaacactggtggttcaacttcaggctctcaaatcacatgcatactcatatgtcaataatgctagttttgacgttacactttattctcaccctggggaaaattatttgtgatgttatttcatgtattttggaaatactcatttggtttatgtcttttctgtgtattgttttagcttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagaggtaagacgattattgccacttaaaaaatatactttatgatttgcatcattacaaattatcattttaagtgatatttagcttctaaataccaatttcatgaaactagaagcttcctgttaactataaattcctgtcaactataaatccagatttccattaaatttaaaaataagaacagctactaatgatgtgtcacttaatttaatttccattctcacaccgacaatttaaaaaaatctacttttaaaaataaggtagtagccttaatacttccactaaacaataaaacaatatgctatacttatcagaaccttttaatctgaaagctaaacagctagatataaatttgtctacccaacatttgtacaaagtaaaaattattagaatattcatttcaaattatgtgtgatgttatcatataacatattatagattaactcaaattattcttaactgttacttaactatgacaaaacaacttagaacgctttgctaatacacaagatagtataaggataaaaattctttatagtactagctcataaagagtgttctatggaatagtagtggatgtcatttaataactataaattcaaaataagcattgtaaatatcaataccattcaatttttttttgttttttaaacaagttgtaagcctaccctatggtaaatggatatggtaacacagcataatttcctcaaaaaattacttttgtgatatacttttaaaggattatatgaatatatacataattatagatgaatgtgatgctgtgtgtcattgtatcaccaaatctctgtccaatctgttaacagactcttaaataaaccatttttctcaagttgttactggcctgtatactgtattacttgtttttcagctttccttggtacattcttaaatttctgcattccgccaccatgctatcaccctaatggatcaaccttttttgttttgctccattctctctgttgtaaatctgaaattgataatttgtttgtctcagaaaatattatttttcaagttctagcgtattgcctacaaaaaccaaaagaattaagtgtctgacactgtgaggttcagcaaaactgtgcatatattttgctacctgattttttgccagcaaatgagtgttttctattataaatatagtatatattgcttaaaaatttggaacagaaaagaaattactccaattaggatgccacctaaagtataagcatgtagctgtactttgagaacactaaattgcatgcaggtttgtagtgactaggtcttcttgcctttactgaaggagcagaatgaagtcacagataatggataaccaaatccattttgtggtaagaacttccttactttcaatgtcttgaagagatgaagtatgttaccaaaggagattgggttttttaatattacagatgagtgacatagattgtttgggagtaagtttttatatgtaagtttttatgtttttaaacacatactgacaacttatgacaaacctttggaaagttttaaaactctgttgaaaggttgtgcaagctgctgatggaatctgtgagcctttcttgtttcttatcacgttttttggcagagcacatttcttccttcccaccaacaggttttgcccttttttttcccattaagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggttagataatttttttctatttggttttactaaatttatttcagattttctactctctgtgactttgatggacatatattgttactatttagggaaaaataaatagtaatatttggcattaatatgctgtgtgtcatttgcctttcatttaatgaatgtgtttctgtggtgccactgtagagatttctcattcttcttagccagactaatgttgagagcggcttctcctccttctgtttcttttcagtggagtagactctaaaagaaaataagtattgctatttggtctctggttaccaattacacaatctaaagaaatacagcacagtataataacttctcacactgtatttcatatagcaactagttaacatatgcctcttacatcttaaagcattatagctactgacatcatgtgaaattactaacttctattttgcccattaggatgagtaatctactcaccttgatcagttttgaaagcaccaaaacttctcaagtatcactgtttctggtctttacactttaagcactttaaatatctttggtaatggattttatcctcctttttgttccctttcagcacatcggtcttattactttctcataaaatcctttgctcccttttccacagttactgtattaacgttgcagacctcagctctgtcatcacctctcaacttgactgtaatatccaccaaggcagagaccatggctgtgttcactcactattcaaatcttggcacccaacacagtgcctggcatacaattaatagttgtttaattaccagtgatttatacttactcattctcttctgcctaaaatctcttaaatttatatttaacttcatctgtttttatgaggaaggattttgttttctgaactcctgagcttgatttcattttaaaggagtttgttatcttttgtgctaattgtggctacccttcatcctacccaattatttttctctcttgaaactggaaaagatggtcatataaaaattggttcagttcttactaaacatttagtagaactagctttcagtgtattatactgtattatctaactaaatatttttaatatttaatatttaatttaatatataactaaatatttttaaacatgtttaacattttcagaaaagacagaaagacctagagcagattagaaattgtaggcatcatttgctttttgaagaaagacattttttcaaatagtggtgcattcttaagaaataaatcaagaaaggtaatgttgctttttggtcatatcatcaggaatgttggtcagattcttattagttacaggaatgaattgatcactactctgatgtaaaattcacttatgatttagtctttttctctaatttgaaactgtggcaacattttaacatatttcaaaatatatctttctctatccattatatttttgataacactttgactctactattagtttaaaggtggttttttagctacctaaacacttctatttcattcaggttttacattaagatcattaggaatgaaagctaacatctgctgatagtataatagtttatatttatttatgatgttatgtgatctcactatccatatatactattatatgcatatgtgatatacatgaatatatagctatacatcatatataccatatatgaatatatacacacacatatataatgtaactaatatgaccctattatcaagctttaacagtatacatatatctctaccttgtttctatgtcatatggactttgtgaaattttgaactttataatttatagggtttttcttttcttttcttttctttttttttttttttttgagactgagtttcactcttgtcacccaggctggagtgcagtggcctgatcttggctcactgcaacctctgcctcttggcttcaggcgattctcctgcctcaacctcccaagtagctggaattacaggcacctgccactgttcccggctactttttggatttttaatagagacggggtttcactatattggccaggctggtctcaaactcctgacctcatgatccgcccacctcggcctcccaaaatgcagggattacaggtgcgagccaccgcacctggcgtataatttgtagggtttttcatactatttaaagacattagaatatgtatacatgtatgtatatgtgtgtatatatagaggtatatatatattgcatatcgtattctaattagtattgcaaacatattttggccttttgattatttctggtgatagtgtaacatgttttctttggtgattttaccaaacattatcaactaccctaaaatctctagcaaaatatatgcattaacagtactctgaaagacatgtacattattagttatatgagatatgcactcttctggatactatattttagaatagtgtgacatgtaaaagaactcacctaaatctcaagtatacttttaagcagtttattattttatttttatctttcaaatactaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtatttctttctatagaattttaaaattcacttttaccatttgtttggaacagggattcaaaaactgagctttctgttctaatatccagaaacctggtagactgtatggaattattccaaagcccttcatttctcctaattttacccttgcctccagaatggagaagaacatggagggatatgttaggaacaatttggtgctaggtactttgatcggttgctgacaaatatgctaaaagtggtcaatcctagtaaaaacccagaatagttctctaaacatggtctgttgtttttctcttattagtatgctaaataataaatagtattattctcccagatttttttttaaaaaaggattcttgcctgtcgtttgaaagattaaaaaaatttgtctctaatctttatttaggtcgtgaggaattctatagtactcatccccattttatgacgcagcgagcattgtaccttgctgtctatgacctcagcaagggacaggctgaagttgatgccatgaagccttggctcttcaatataaaggtgatttgttctgatcatttgaaaatagaaaataattcatgtgtctgtgtgcgtgtgtgtgtgtgtgtgtaagttaatttattttgggcaaacaattgcttcagtctctttaaatactttcttaaaagaagcactaaaattttgaattgggaaactttccgagtaatgaagtcataacatgaaaattgtatgttccatgttggtgaatgttattggtaacctgaaactcttttatgctgtaaaacttgaaaatatatatgttcaactgttttttaattatattatttcttaaatgaaatctaaatttttctaatttaaaataagctatattaaagaaaagcaatctatatatatatatctcatcaactttgtactcaggggccatttagtgtgaaattcttcagattgtatcctttaagtggtcccagattattatgctgttacatctggaatctcccttttgttgcttttctatcttttcctttgttgtcttgttgtcagctattccttcaaacactatggctttttagaatggagactaaactgctgcttgcatgatgctgcaatgaactcttctgtgcataaagtccttaaaaagcttgtgtcaggacatttaaccatgtaattggctgcatacatgcttgttttgtaatttgggtattttttaatgtttcttttattaacttttttacagctagccaacgtgagcaaatagtacagtggcagtcatatttgcttgagtggcttttattctttcattgtagactccaaattggttgactttaaaacgaatttagaagattaaattcacagataaggaagagaaaatataaactatatgacgttaatttgatataatttgtgggtttatgaaatgcttattttatttaggagtgaataactcatcttaaggcatgaagatgggaaaggaaaactataccactaccgttatatatgccacctaaaagggtgaagaattgggttaagaaaggccaaaaatgactttttaaaatgtcgtaaggttacatttttttcttaggtttaaggaaaaaaggacagttgttcttttcttcttctgaagtctgctagtttctcttttccattcaagtgaatgtcacggaaagcaaatatcaacaggaatgtgagcaggcccagtttgaaagcaaacacaagagggttttgtgtctttccctccaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaaggtaacatggtaggctggtagagaaatgtaatttattgattctcaactgcctagaaatgtcagaaattttgagaagtgagcaactcacttaaaattgtgggttttctttccttgttgctgttagcattattaaagtcctttccattttaaaattatttatgccagacttcatttctaattcatagaaatgggaacaaaaaataattagaggaacctgagagaaactaagagaccgtttctgggatactgagaaaatgtttctgagagagaatctgagaaaatgtttttgatgccttttctgattcaacttcttatagtggtgattcaatcacaagggtaaaggtgaatactgaggtcttgggatcatctttcttctattattctttaactgttatttttccatttcctcttttcttttggaattcctgttttatggacatcttgatcttttgtgccactcattcatgaattttgtcactgtgattcccattccaatttttttccctccgtattgtgaggcagctgttttatttagtcatgaagaccactaacttggttttcagcagtgtctcactaattacttagttcatacaaaatgggctttttattttaggaattatgttttaaatgtttaaagttatcttctcgtaagccaaatttttataaaatgtaaataaatcagttatcagagagaacacttttttttttaaatacttggcagaaaaaagaaatcttcactgggtactacagggagtgtggtgtaaactgtactgaaaaatacccttgatagttccatatgacaaacataatgatgaatttcacttagtctgtcttggcttagctcaatagcactaatgatcaagatactggctgataaatagagtcctatttggcctgggcagtcccagcataattatgtaatagtgtcccactatattctcaaaagcattccaatttggatgataaattatatagtcaccttggttataactccatgctggccagttagcttagttctgttccatttatatagattatgtgtgcttcactccaaaacctaatgagccatttgtaaaagtgatggcttttgcggtgcccagggagagaatttgtatgtttgtatccttcaacacacatttattacagttattaaaaggttttattgatgatagatggtaatgtcatgtaaaaatgacatattatttatttgtagactttcctattctcttgttggacatgtaattagaaactaatatgacttaaagaaaaacaaatacacaaaatttattcatccaattaatctcttaatccaggtgttttttttttctgagactatacccatacttcaataactttgttgttactgagaatattttgagtttccctttttgtcattgttgtcagagaatgtatcatatctttaaaaagacttgttggaggatgagtttgttttgaaaaggcctgaatttagttgatgcaaagtcacagataagatggttcattaagctgtattaatactgcttttgtctaatagatatcattaccaataagtcagactagtttttcttttggcacttataaatcacctttgaagacaactttttacaaggaaataaaacaaatgctttgagaaataccagtattattgaaagaaaagtatatattgctaatggatgcagcattctggcataatggtttgaaaactcatttgattgctttgtagaagaatgactctttcagatgacccagggcctgtgagcctgccagaacttgaaaattctttcttccctgaggtgcttcaacctgaattcaaagagcagcttttaatctattagagatcattttttgtcctctcatttatttttcatatttgcctttgatcttagctcttctctaatctttttctgtctcaaccttattaacaggtgtctgtgcagacacttttaagttttgttttttggctcagcctgtcagttaactgataatcatgctgaaaggagaagcaggacaaaacagagttcaatgctgacaatactccttttaatcttgtccagcccattagcagagcaggcatctctgtgggccttgagacgtagtcccgtaaaactcatcccgtttctacttgatttgctttctttgagaactcttgtttatttttatatggaggtttcctgccttggattaaaacataaacctcaatctgaagttcaatttcatcttaatttatgaacgactaagagagggaacatgaaaagtggaggttagtgaaattatctctaattctctgggttaagagatacatgaaaacagtctcttgagtaaccatttgcaggtaaatatggaagtaatggttatggttgtctctttaagtttttagtcacaagtagaaaaagaccaagttaatttttttctgtgtgtgctgaatttctatttgtagtaagtgtaagaatttaagcagaaattctgattcgtattttcagataaaaagaatatgtaatttccataggtccagaaatagggagagtttgccatctggtggttcttaacggcactctggatattattaagagttgcatttctatttaaaattatattttaaaaaacgtttggaagatacttttattgtagaaactatcctcttagggccattctttaaaaaaatcttattttatatatttctcattttgttgatagtgattagattctaagagcaacagaacaatgatcatcctctcctatcagaatcactgatgtttagatgatttctcattttcccaagttcaaggttccatgaaaaacatagcttgagtgggattttatgtctctgcgtttcactgttgatatatatgtcctcccaatataacattttacaaataaccaagcacaaaatttaatattttaccttgaatatttaaaatataataatatccaaaagctcttgtaatttgtactgatatcttatactagcgtgtctgtttcacattaagtttaatgtcttaggatataaaaaatcttttttatggttagtgatttatcttgtttttttttccatggaatttctggatagcgagataaatatttccatactattttatttgatatttccaaatttgcctctgaatcaacaattttcctattttaatttcattgtacttgttccttacaacctaaatagctttttattatattttgattttatttaaaaatgtacttctgaataatatatctgtttctgtaaaaactgttagcactgaatttgccaaccatttgacaaatacacaaataaaatagatttttacggcttgtcatttgtaatttcatagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggtttgtgtttttcgttccttattttcaaagctcagctgtagtaacttataaaagtgtttctgaatcttttatagaatttacattcaaagttgagagaatatccatacggttctttaataggccactgatttttttctttttggaagatcatcatgtgtgttcatgacaaatcatgtatcatgtcataagaaaacaaatttagaaatcacctaggagtaaagcagtggaaagagtccctgagtgggagttaaaatatttgggttctagaacttgtctttactattcaggagctgtggaaccctgaatagtcaaatgacattcataatgtcaaatgagtttagtgcatgtgaaagttatttttatattgcaaaggggaattattgttggcatggtctaactgggacgcttggagagtcaatggctccctgagatgatgcagcttctgagtggaagatctagctctcttgcatcaaatattgatctcaaagatgaaaattctcaaagcaacttcagtgctaattgtgtacttgatcatattaccttgctagaaatgtgtgagttgtttgatagtactagagtaagtgactgggaagctgcttttgatccctagattctgttgtataaaaaatagcttcccgtggtttatgatctgttccttttccccatcgttcttaaggtatgctgagatatgctgtgtttcttatctgtatttgaaaataaaacatgtctttgtagtgtgtattcagcaagcgaaacagaaaattatgaatttctacttatgtgtgaaatatgctctgtaatgcatgtcagtgtctcaaatatgcttaaatatgatcattttatgtagtttaaaaatactccattataatattggaactttagaccataggatgcacagcttctagtcccagctctgtcactagctatgctgaaatttcttcacctgcaaaatgaggaagttggactagattttttctaaagccccttgatatttgttctagattccatgtttcactgtttgatgactttttactacaggagtccttcttcattttcaagacccagcactgcagttaagtgacttgtactttgtggaacccaagtggctttgtaaaatcatggcacaggttggtgtcttttatttttgtggcacgggggttatggtcaaagcatagaacagatggcgcccagagcattgagcattttagaatttgggtttagttaaggcagaaacttttgtgaatttggaaaactgtggaacatttcacatagaagactacttgaagagcttcatggaagaaggaaagatgtcttgagttcacttccatgacttggttttcaagccacatacagatgtttgtatcactctgccccatgctgctttactagatcctgatgatgtcattggtttggttactgaattagtcaattgaatgatggctttgtggaaatccttggggtaaacacatataagaaaattaggttgctgagcctgtgaaacctctatctagataacatggaggtgagttttgacttaagtgaaatgatctgagctttaaatgcttacgattttgaaaactttggatggccttggttatagctatttttttcttatatttcacatggaaaatgatttttttctccaaatgataatccattaccaatgagtttaattagttataataatccatctctgtagctttgacataaaagaccatttgagcaaaacatactacctcagggcttttcaaccccagcatgatgacattttgggccagataattctttgttgcacattgtaggatgttagcagcatttttggcctttatattcgagacgtaagtagtatcctctagctgtgacaagcaaaaatgtatccagacattgctaaatattgcttggagaatgtgaaaaattaccctagttgagaaacattaagctactgatttgttgatgagtaaaatttatagttttgcatgtggctgcccgagttcctaaaattattatatatttttatgttagaaatatctcttccaattaaaccataaaggtaattaaattcactcaggcagccttgaataattgttcctaaattccatctaaggaaaaaaaggaagctattgtgaagagagaactcagttgaggctaaatcctgtaccatggaactcaagagcatattgaaacattgcaatcagcaattatttgcagtgtgtcagttattactattttggtaggtatttttaaattagattttcagccttctgcacatatgtcatggataatgtgattttactcaattattaaatgataatggagacagtagtgtgacccagagcacttacttgagcatcagcttgacctacgtttcagtctctttaattacttattagctctgtgaaatttcttaatgcattaagcctttgtttacttactttttaaataaggaaaataacaattatcttctatattgcctccctggttcagtgtaagtgaggggtaaatgttagctaattttatattggatctatttggcaatttaaagaatgttaatcaggaaattttaaaaaattcagaactataaagaggtacttacgtagttttggaaagtgtgtcatgtatggggacaaataaaaaagatgtgtaggtagctgcatcctgtacagcaaaggaagttttaaatatatccagcaattttgttgtcctagctggcgcacaatagttatcaggaggtaactcaactccacatagtcaaggaaaagctaaagttgctctctaaagtggtgtgtttccatgtcactatggaacacttgaagttgcacacatgtgaacattaggatgggtatatcttatacagtagaataaggaagaggtttgcatcagaactccccttttaaaaaaatgcagattttcactatgactgcaataaaattcctgaagattctgtggagtaattaagttgaaactccatgaaagttcttctcattagcatagttataaatatgataatttaagtaaaaattaagttaatttgagccactcaaagttacttttaaagacagatttaaaatgtcaataaaatgataatttaaatttccgattaacctaaaaaagaagtgccatcatttttatttatgccaataaattgaaatataatgtcattttatcactaaggtttaaaggaaatgaaatctctaaataatcaagtgaaaccaagagcaacttgtctgacagctattagcaaaaataaataggagtattcaccttcatgaatcaaggcaagggccggaataatttcatggtgcagaagctctaatgagcccacccactctatgcgccccgagctgttaggtcactaaacttattaaaaaaaggtaccattaaggcagggagaagtttacaagactcatttaactgtatgataaaagagatatgaaagagacctattcaattaatcaggtggaacattaaaaagcttacatggcaatttaaccttgataaaaatacatgggagaaatacaaaggaatttggaaaattctctttccttgaataaggcatcagttagctattcaggttatgaggttgaaggaatgttaggagctcttttaaaggtgataaagtcaagataatgttgcagattttattcttatgtaacaaaccccctcgaaacttggaggcttaaaatgtgaacaatttatcatttctcgttcttctgtggcttgactgggctcagctgcgtggttctgctccacatggtattggcaagggttattcacttggcttcattcattaaactgagctggaaagtgcaagaaaggtacatgcatgtttttggagtattggtgcttctccatgtggcctatcatatggctaagttgggcttcctcgtggcacggtgatcacagaataattagacatctttcatggtggctggttaccaagagaaatgaagcagattttttctgtcctcttaaaggctaggccaaggactggcaaaaatattaattctgctacattctagtaaccagagcaaccacaaacctagctcagattaaaggggaaggaaaagagactctatatgaatagcacctatgtatagggatggaaatgatgtgtccatctttggaaacttccactataaatagtggtagcacgctatagatccactaggaaaatcaagcacaaactctttaaaaaataagtgtatcttagtaaaatagattagaataactagataataatggctaacatacatgaggttaatatgtgcttttcaaagattagctcatgtaattctcacagcaacctttccaaatggtactttattagcccctatgatacagatgaagaaattgattgacagagaggttgaataatttatccaacggtacacattcaggaagaggtagagttagaatttcaaaccaagtagtttgactccagggcctatgagtttatacattcatagggctgatattcaaatgagagaagagaagtaataaataaacatataatatgttgagtggtacagagtgctacaaagaaaatatgaagtgcagttggagatgaattgtcaaaaaaggtcttagcacttaaaaaacactaaaacagcaaacaattctctttaccacctaaactgtaagagcgatctggaattgctataaagtacacaacatgggagaagtcttaaacaacagtttttattatttataggcccattgcacactgtcattaaataccaatatgttcaatcaaccatgcattcattgattcaataaatactgtacatacaaaatagaaatacagaaatgggtaagacaagtccttgggcctaaggactttataacctggtatttcactcaactacatgatagcataaataatgtttgcttctgtttaagtattccttaaacattatagatctcccaaagaaaattaaatacaaacctctttttaaagtgaatttgacaaagcaaaataaattggaatatatagataaatatgctaaaatttgtcatatgtactttgcgtactttacatgtgttatttcattctcagggcaatctaagacagtcacttttattatctcattttatagagaagaaagctgtgcagtaaagaaatcaaatacctttcccaaggttacagagctagtagtagagcctggatttgaatctgggttctgactgatttttaactgccatgacaaggatcaaagctcaaagtgtgatctctgtgttagaaacatcggggttgctctttaaaaaagccgattctcaggcctcaacccagacctactgacccagacactgcaagtagaatccatcaaaatgcagtagttactttgagaatcatgaaactctgctacacagtctgtcttcctattcatggaagtcctctcctagtatataaatgtgaagtaatatttctatttcaaacctgtattgataactgtctggaagataattttcctgggaatatattattgatgagactgcaaaacagatgtgaggtattggattgatctttccattgtagctagggaaatactgatgttcattgtttcagtgaagttcaatgatttcctatccgaattaactcccttaatttaacaattttttttttttttttgagagtgaatgcccctctgggcttctaggccacatggttgctagagaaattaggtactgtgttgcacttgaaaacactaaaatctttctgactactttcactgagcaaagagacataaaatgctttaaatttgcaacatttcagaaaataaattttagtgattatttatgactcgaatctttcagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcaggtaaagaaaaccttaaaaaattaattgctacatggaaattcactatctattcttttaattgtcaaactaactgtagtctataatagatgtattaaataaataaatatattttgcttctagtgtaaacctcctactgacatgtatcatttattttggaataaaacattgcatctgacactttaacaatatagtaaatcacttactttatgtgtatagttactagttggcttatcactgttgaaattatttaagaaaggtaaatagtggagattaatgtgtgtgtgtgtctgtgtttgtgtatgtgtgtgttcttaaacaacactgagagagtttattaagcaagttctgagaagatagtgagttttcaacagaattttaaaagcatttatggcatcacaatggatgcctatgttttagcctatactatggaaatttttcctactgctctaagcaactgggaaatttataaagtaatatgatgttgaaatgtgcaaattacattgattgatggatgcagccaattttaaaaataaatatacactttttttctaggacatgtatttttcaggatttatataagattacatttgtctatgcataactaattgtaataatttatgtattagtgcacagggattaccgaaaatatttcatgcatctacatctgagcatgcatttgaattggttattgaccactgaatttttggtgtaggaaaaatatgtagtgaaacaatgttacaaaaagattacaattgtttggaatgattaccttcattgactttaagcagtaaaatcatttgctcaacaaggttgggtgttttgtgaggctgtataaccatagtgtccttttgcctttagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagaggtaagtatctaatgaagacttattagatttttagagactattaatttagacttattaatttttagagaaattagggagatggcatatgaaaagtaatatgccattttctcagagtttacttgtttggaaggcagctgaagaattagaaaataagctcataaaaccttggagtaggcaatctaaagacacacaagcacatataacctcatctaatttgtcaggaagaaaattccttaggtgctcactcagatcttgactgtgattacattgtagggactgtaattatctcttttctgttgcacagccactaagacatttacaaaaaaagagcaaatccggtgtttataatgctaactctttcttctaaaataaatagagacattttggtactccaaagggaaaatatcattttggggattaaaattagctttacacaggtgttactggtttccaaaataaaccttaccttgattggaattaatcaacatataggtagttacattgcattaaaaagttcagaaagttttgcgtttagcatgatcaaaaacttctttttaaaaattatgaggatttatttatgattttctttcttcatctgtcgagcatattaaactgcttaacagcatcaacctgaaatggatcttaatgtgcaggggatttaactctttttattgtaaagttgtggataaaatatttaatagatatggatgaggactcatatcagtaacaacccaatactttatttcaaaatgaatagatctgtattacaatcacttgtgttgtgtgcagtagattttttccctttaacttaggaagcagttaataattaatggctccattttttagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggtaaggaaatcaatttgaatgttttcaattgcaacactaaagaaatttaaacttaaaaaaaaaaaaaactttaccttaaagctttgcgacagtatgaggtttagacaaggtgttgagctctgttttgaatcatgtaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggtatgttttgatacaacttacaaatgcttttaagtgatccttcaatacttatgaagtgacttttaataaatgtaaatattcttatccataagggatgagttgaaaaatagtatattcaattatagggacagttcagaaaactgaattatatttattaccaataaaatcttgtattctagattcagaaaatgttgatttgagggtttgaatgctggcttattgagcaacataacctcatctgtgaaaccggaataccaaccacatctatctcatagaactgttataaagattcaaatagacaatacatggacctaatttaccaacatgtctgccatataataacagctgcagcttcatgaatgtggcaaaagcagagagtagataactttctagtcagatgtctggtagtctgcagcagttcagaattctacaagtgaacgtaggaataagtttttaaaattccaagtagatagatactaagtgaatctttaaaatgttctcaaatttcctagagaaatataggattggttagaaagggagggattagaaattatagaaaatattccattattttttcacatcaaaaccacaaatttatgtatctccttaaatgttgtttttatttaaaaaatgttttattacttctcaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtaattctttttgttaatttgagaataaaaattaggatgtaattttctccttataatttagaaaatagatttcataattatattgtcatagattttactgtcttcatatatttgttataatttttgtatttggaatgatatattttaaaggaatataatattacagatctggaatttgttttgcacataatcatgtagactaggatcaagatgaggatgagattatcatggaagcagaaatatttatgaaatatatctttgtatttgccttaattgccagggatatgggaggcaaataagacagttttcaggtgagttaagtgaagcagccatattttataaaatgacagaataggtaaaggaagcacacctcagtgtagccatagcaggggttttatgactcagtgtgacaatgctgaattctcatagaaatattcattaaaagccttgaaattaaagtcaaaagtgttacatggtgacatactcaaatacttttttttttttttttgatatgctgaacaatttacatttcttggttccgtgaattcaatcagtgattttcagtagagtatgatggaaatcattgaattcatgtagcatgtttaggtgctcattgagaaaaggtgaagtcatggtaaccatgtttcaatattctcatttgtatcttgacttcctgcacatggatttttgggcctaaaagatgtttttaaaacatgctcatacacttcagaagatgaaaagtgtatgcattataactactttgggaaagaaacagtcaacatatgttactgtatgtcattctgtagattacatgtgtggtttctcatgtctctcagaataaaagctaatgtctttacaagacctgcgatgctgtgatctgtctggctcctcggttatcatttttaaaaaaagatatactttgtacaaatttttttaattgacaagtaaaaattgtatatatttatggtgtacaacatgatgttttgatatatgtatatgttgtggaatggagaagtttagctatttaacatatacattatctcaaatatttatgtggtgagaactattaaaatctactctcatagcaatttacaagtatacagtatgttattattaactgtaggctgacatactcaagttttaaacattcctgagagtcattgggacaactatgaaatgcattagattgatttaatataaagcatttgaagacaattttgaccttactttgtttagtttttgttgttgttgtgtgtatacatttaattttaatcaaattaccccagaaataatgcctaagatctgtcagtcaggacataatattattagcaaaaagttgtccaaaatttgagacatgatatttaaagctaaataaactcctttatacccctcttattggcattgattgggaagtttaggttgaatttaaatgctttggaactcaggaagttaatgtattagtaatagtgggttaacataaaatgctgaattgtccttgctgaatcctacatcttaaccccagacttcaaggtatacaggaaagtaccagacatggtgcatccttcctctgaagaaatcccaaactgtcagacacagatccctaaaatatttctttttcctgcattaaaatgtgtttcagatgaatggacacgttttgagtagtgtatgtggaaacgtcatttacaaagtctgtttagttggccaggtgtagtagctcactcctgtaatcccagcactttgggaggccgaggtgggtgtatcacgaggtcaggagttgaagaccagcctgaccaagatggtgaaacctcatctctactaaaaatacaaaaaaattaactgggtgtggtggtgggcatctgtaatctcagctactcgggaggctgaggcagagaattgcttgaacctgggaggcggaggttgcagtgagccgaggttgtgccactgcactccagcctaggcgacagagcgtctcaaaacaaaacaaaacaaaaaacaaaaaagcaaagtctgtttagctacccatataggaaaatgtttgtgattactctcccttctctagacccatgtcccataaatccataaatcccatgttcatttacagaaagcagtctagataggagtttctcagtctttgagctgttgccattttggcttggataactaactctttcttatcgagggtcatcctgtgcactgcagaatgtttggcagcatctctgtctatccactagatgtcagtagtatctccccttccctcagatgtgacaatcaaaaatgtctccggatgttgccaaagataaggggtggggttgaataccagtgatttaaacaaattaggtgtatccttctaaaaacattttacaggtagcgactccagcatctttatattagagtaatctggagaaggttatgcctctctcaattttccctctttccatttttatttgtagggcagcaatgcattcaggcttttggtaactctttttcccaagatagcagtaactattatgcagtgagtaatacgacccaccttaatagatatgaatagacttgttttgtgaatatattttaaaatataaatgtatgggattctgttcatgcgtctgagaagccacagggtacatttcctctttgtggagctatttatttttctggagagccaagacaggtatttccacttcagtggtgtgatttgaggggttaggaaaatttccttgccttcaattttctttccaacctagatgtcacaaatacataatagtagtccttaactttatttttgttttcagtcacctgaaagacatgacaatccatactccatattaatgcagcggcgattctcaaatagagaagggctttaaaaaattagaaatctctgccgggcgcagtggctcatgcctgtaatctcaacactttgggaggccgagatgggcggatcatgaggtcaggagatcgagaccatcctggctaacacggtgaaaccccatctctactaaaaatacaaaaaattagccaggcgtggtggtgtgggcggctgtagtcccagctactcgggaggctgagtcaggaaaatggcatgaacctgggaggcggagcttgcagtgagccgagatcgcgccactgcactccagcccgggcgacagagcgagactctgtctcaaaaaaaaaaagaaaaaaaaaaagaaaaaaaaaacaactagaagtccctactccaacttgaaatttggatgtatctccctagagtatgtttcttctctatgctgcattgcaatttttctttgttgttgatagttgtccagattgaggggaggcagaacaagatgcatctatatgtttccatctctccgaccgattctctcccttccccctctacttgctttctttctcttttccctcttctgtttacccgattctatttctgattccagtatgtaacagttccctctgaagctctctcaataccaacaatcctaactaatggtttttaaaagtcaaatattaagtactggagggatagaatgagagaataccaagactgataagatgcaaataatacttttaacatatttacaatctaatagaaatacaagacatgctcaaataagttaattattttaatatactctctctgagcataaaatataattatatatgctcattatagacatataaaaaataaataggtagaggctttccatagatgtgtaatttcaccacttgaaaattactatatttccttatagactgttttgtgtgtattcacttatatccatcaagtgactacatttcaaggcactatatgagaaccataaatattgtacaaacaggatttgctaaatgtcggtggagagtaacagtccacggggctgatcatggtcagtttgtgaggcaggcctccaaactccttggggattgagatgatggagtagcagagctcttcaagggtatggaggcctgaaggtacaaagcatgctcaggaaattttggctattgcggtttgtctagagcacttgttctcaaccttacctgctcattactaattctactaagtacagaattaaaagaagaaaaaaatctaatgaccatttcctcctgggactaattagatcaaaatctttgaacccagacattagcgttttaaaaagctcctcagatgtactattcagccaggactggggcagggaaagctactgaactccagccttgagaatgagaagtagaacaagaggagaactttaaaaggatttaggggccactatatgactatggagctgaatttagatttgatttagtaggcaacgcggaataatttgtttctgaacaggagagtgacacaatcaaagtggaatgataggaaaattaattttgcaagagagagagaatgagttggaagtaaggaactcagaaggcctcctgggactcagcagaaagctctgaggccaccaaatgggtgtggtggtagtggaaatggagaagaagggaatgtaaatgaggctacacagtggactgccactgttagccgtggggttagaccacagcaagagttaaaataattcttcaattttaactccagaagggcctcaaaaagactttttgtcttgttatcatcagctatatggaaggtagaataaaaactagttaggagaaaaggtaataaatgtggcttttgataggctgtgattgagttggaagggcataccagtgaaatcaccaacacaaagttggaagtgtaggaaagcacttaggaggtggctataagtgaaaatgtgaaaattctctacattaaagggatagatgaagtcacagaagtggatgacataattgagcagggtatgtgtagagggaagacgggaaggttaaggacaaaatctttacatatatctttcttggagtagaaggaagaggaaatgttaaaggagatttgattcaatgaaacaagtaggtcaggtttctattcaaatttacaacagatataattacaacagatataatttatttagtttttttcgcttggacagcttaatttaagtgctttgtattttcttttcaaaaggtgatggcagttttggatcagtttaccgagcagcctatgaaggagaagaagtggctgtgaagatttttaataaacatacatcactcaggctgttaagacaagtaagaaattcaataatataattatattaaattgcacattattaatctactggaactcttattttgcatacagttgtgaaaatgcaaaataatgaccacatttctacttaagtttaattatgcaatcctagtttgtcttttcgttgtggagtagaaagttttgtgttatttctcctgttgagaaacaaaacactgtatctgagaatccttataatcgtgatacatagtgtgttgtaaaactttttgtaagactcacttacactcctctttttactttagaaccttgctgttcaaaatgtgctccatggacaagcagccaggcattacctaggagattgttagaaatgtagaaacttgggacttttcagtgccatattattgttcctgatactccacagtagtcagactcctagctgcctccacctgcttccagaccttgaagcctagcaagctcctgacttcgccttctgttttcttcagagtatttatcttttacttttctggtctagggagagaatgatttttatttttattgaacatgacttctgtgtgttcagggtgaaagaagaagtttaatgcatgatctcacattgctaatttgattgaaggttagaaatcttaaactaaaactctcactgataagcttgcacctctcttttctggatttatccactttaataagaactgctattgattacttgctacaaagatggagaaagttagcatgcttatcctatttcctactccctgtccctgtccacttcctaaaacttaaaattggttgcattaattttcctgatatagtaacaattataacttggaatgattttcaaaacttttgtttttttagtataccaactctagacagcatggactgactccttgctatgtgagatgaggaaaattaacgctattctttctccttttcccatcaccttctcaagttctttaatttattctattatttttatgtagtgaaagtttataacatttatattctggtctgtactcataattaaattgttcacattttgtctatagtttggttctgagaacaaaaccaataaatgccatttatatatttttttatttgtacagaaccaaaatatttctacttctagataaagaaatgcaaccttctgtcactaacttcttttactaatagaatagtaacattccaaatatcaaagtcaaatggattctctattgttatgtatttatcatcaatttataaaaataaaggcatattttaatttggtcacatttttaccctgatttaaaaaaaaatttgtttttagagatggagtctcattaggttgaccaggctggtctggaactcctggcctcaagtgatcctctcaccttaaccttctgagtaccagtggtgatttattttatgtagctttttgaggttttctgattatatacatatatttttaaaaaacgtacttcaggaaaagatatatattttcatcatgacttcaagtgtttctaagttcttaatcatacagtttgtataacagaatctactttcttcttgaagacattcctcattcagcacatgacttactgctctaaacaggagagatggatttctaggctgcttgtgcagtgattaatctatgagttagtttcctcgccctctttgattactctcaatatttcttggattccatccattctcttggttggattgtccttagtttttgttgaagaatatcttcgagtaatttttttaagaaaaggtgtttgtgaggtaaatgttttcagtccttacatgttaaaaatatcttagttttgccctcccatgtggtggatatgtcatcacactttattttttaggaatctaggcttgaaacaattttcttcaaaatttgaagaaaattccattgatttttagtgcccactgttgctaatgaaaagtctgcagtcagtcagatgtttgctcctatctaggatacctttaatttcattttgaaaactgaaaatttgaccttttgaatttcatttgttttcagtgttctgaacctttacaagtatgtgtttgtgtgtaggttgtttttcattccatctaattcattattttgtgaaaaattgtcttctgtgtattctcttctattatttattatttcctccctaacatttattaatcatttttattgacaactactatgtaccaggttaggtgatgggacatatgatatatatatagtagtaagctaaacccagtcaaggctctgcttctctggagcctatatctagttacttatgattcattattgcttatcattgctccaagagtatatgttagatgacaagccttttgggtctatcatccatgtttgagttccctcttcaagttttatctataatttgtgttacttacttgactgtctcttacaggtttctaatattttttagaattgcatcatctattatttagctttctggtgaattttgttttgataatcatattttccatttccagcaattctttccatcccctctggttgttcctttgtagccatgtttttggataaaatgtccataggtgtttctgttcatgtcaattagaatttttttttgtattacttgcattattgcttttttctctgaggttatttgctctgtgggttcatcttgatctttctcttttatcttgtcagttttccaaattgagtagttttgggtgacttcgtatgaagtaagtactctattgattgttaaagaaggactgtattgattattaaaggtaactagaatgggcattcttcacattcatgtaggtttgcttgttcaagttaccactttctgaacaagaaggttagaccatagacttttaagggctgcatactgcaaagggatactctgttctttaggttacatgggcagggatcactgctgagaccatacctgccaaaggaaggcaggctttgctctctagatgctggacttgaaattgtttcccctctgcttagtgctgcattattttttttgcttcttaatctgctgcagagtatctagatcagggtgtccaatcttttggcttccctgggccgtattggaagaagaattgccttgggccatatataaaatacactaacactaatgatagctgatgagcttaaaaaaattacaaaaaaaaaatctcataatgttttaagaaagtttatgaatttgggttgggccacattcaaagccatcctgggccacatgcgacctgtgggccacaagttggacaagcttgttctagatacttcagactctgttctacatctcttcatagatcaataacttgcagcaatgagtttatcagataaattatgttcacttttcatccataaaaaaagtcatgggaggtactcaccataggattggtttaatccagtcactctggccaattttctttaaaattcctttaaccttggtatattggtttaattccttcagaatggcttttcccattgtgataaactggttccaggcttcacgagtacttattccaagtacagaaggaaagagggtacctcttttgagtacttgtatttcaaaggaatcaaatggcctacataataacccattaaataaatagatgtctctcagccccagtgagtcatctgtgcttttctcaacaagcactatgttcagggcaatgctttgtgctaattggctttaggcctttgttaccaaactgatcactgtggccctgagggtgctgttacttagaatattcccaccttttctgagaggctgatgttggggtcacttccccctgaactaaagtccaggggctgcatgggtgagggttgagtaactcagtactctaaggaggaaaggaaggggaatatacactgttagttaacagtggttattcctgtattctctcttgtttggattctactggggatttctttctttttttgagtctttattgacattaggaatgagagatagaaacagggtgagagaggaagtaaaattaaatgtgaattcttccatcttataccagaactcaactgtatttttggaatctatatatccttacttttcccttgatttattacaaaaaattcttagtggctacactaagtaaattttgtaacctttaaaaaatacatagttataatattttaagtactctgagtaatagaagatttcatgtgagtacaaaatatcctgggggcattttaattattagtaacaacagtcacactgtagttctagaaccaaattgaacattttatatatagaagcttatctgtgaatcaaatctgacataatctcttttaatgtgtaggtaatttcttatataaattgattttttggccttgctgtcagcatgcatttcaaattttacaccatgtgtttggggagctatggtggaaattagtacattaaaaatgtctacagagccaattagtgtataagcagggaggcaaactaagggaatggtggaagaaattaaaaaaaaaggggtgtgcataatgtgcttcttctcttaaaaaaaaaaaaagaaaaagacaacaacaaaaagaaagaaaaatgacatttgacggtcattctaccagtagtcatggggcagatctatattatactgtactattacgctgttttttctttgcaattagtgagttgcttttccaggatagaaaatttggattagacctctgtctgtgcctatgaaaacaagcagagctaacttaactccttctcatcagttctaaccaactgacatgggcattaaaaaaaagattttatctactaagcaaatatgatcacagtctgaagctttgttcttggaaaatcccctctcagggtgttcagcctttcttcttcagcttgcagaattctccatgtttcagtttcctgataaatcagtgggcgccgctactccacatctttgaagctggttgttaagaagcagtgcttctgcagcaatcacagtttaaagcatgaatcaatttaacatcacacaagctatacatttcaacagagttacagtttcagagtaaagtgcaatatacagtataaagcgaatctggaattcaagcccaacaatgtcataaaagaggctgtgaagtctcacatgatgtgggccacagagagggttgttgccattggatcttagctcaaatactaccacatcttcggagtggcctgccatgggccacccttactaaggcaatccctctgtccaagccaaaatgatatctcggactttttttgaattgcagagagattgttgcagccagggattgccttagtaagggtggcccatggcgggcctctctgaggatgtggtaatatttgagataagatctgaatggcaagacttcagccatgtgaagggtggagggatttctagggaaaggggtcagcacaggcaaagaccctatgatgggaagaagctgggcacagcttgggattgaatgaatgccaatgtggctgaagggtggtgattgaagaggagggggagacgagaaggtctggaaggcctggggcatgatcagatcaggtgctgaggccgtggaagtagatgggattttcatctaagggaaatgggaagtcattagagagttttcaggaggggatgatatgtatttttttaaaattgagcattatcctcggtaaacttttgtagtcgttaaaccagagattataagcaggttttacctcatatgccagttgcagctgattagtagtggctatagagaatcctgggctgagaaggatactgtggctaaccagaattcagtagatgagtttgacgtggcctgttagtatgactacactgtgtgcactgtttctgcattaaatgtctgataaaaacagagccaaaggaaaaatagaacttaaaaatttaattctgacagtacagttgacccttgaaaaacataaaggttggggtgctgaccccttgtgcagtcacaaatttgcatataacttttgacctccccaaaaaactgaaccactgatagcccactgttgactggaagctttactgataacataaacacttgattaacacatgttttatatgttatctgtattatatactccattcttaccataaagcaagctagagaaaagagtattttatttaaaaaatcataatgaagagaaatatatttaatcttcgttaagtagaagtggatcattataaaggtcttcaccctcatcatcttcacattgagtgggctgaggagggggaggtagaggaaaggttggtcttgctgtctcaagagtggcagaggtggaagaaaatttatgtatatgtggactcatgcacttcaatcccatgttgtccataggtcaactgtagtttcaaaaccagctttttattactgaaaatacgggaaaaaaaactcagagaagaaatggaaagtttgctatgatccagtcatacagagaaatccatgttcagcctgttgatgcactttaaagaaggagatacgtgggtaaaacctgatgttgaattactcttacatgattttggacttttgcaggagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgaggtaagtaggtcatgttgttttctattcagtgcatgacaagtgtgatccagacttgctctcaggttctgagaacacttcccagtaacactgtgccccagtaacaatttataaacaatttggatgaaaactaccatttccctgatcaaattttgtaatttcagaaaataagagtatggaaaccatgcagaacctcatagcaagtagtaatagactttgaacccacaagttctgctctagaacccatcatcttaaccctgtactgatctgccttctataaaaatgtataagttaggcttcacagtatcaaagtaagtgtcaattacatgattccaatgaggaaagatgagtccatacttctcaaggggactagagtgattcatgttggattcttcggcatgaccatctcacatgtctcagaggcacacctaaccctgcatccagagcaagctttggagagggagcacactggagtggaaaggctgtggtctttgaagacaaaaggcctgggattcatcactattccacacatttagtaactgtgattttatatctctgattcccattttttaaatagtctgtgaaccatgactaatatttaatgcataaaattatgatgacttctgtaataattggagacattccagatgaaactcttgatgtcccctctgccattgctccccaaccccagtcaccctgttacacctgagagtcaccttacattcctttcttcctctctcatttcacagctaatccttcagcaaatcttttcagctctgccaccaaaatatatcttaatgcttctaacaatttctctcactaacgtctaaatctgagccagtatcatctctcattgcctactggtcccctgcttctacctctgtctcatgatagtcccattcctcacccagcctctggagtgatttttctaacatgaaagttggatcaggacttgttcctgttattacccctcccctgccttatttcttgggtacagtgctcagccactcccatccctgaggttccttgcagataccagaggctttatatctgctgttgatttcactcaggaatgtctgactcccagatgtgctctctacttattataaaggattatctgaatctttctgaatcctttcatttaggactctcagcagagaggatgtccgcaacgaccctttgtctctccagcccctataggactattgctgcctaggattctttatgttttcattttttaaaaacttatttattgtctgtcttgccatcagaatctaagtaccatgaaagaagggacttttcgtcttgtttgccattgtatctctagctcctaaaatagtaagccttcagaattactgtgttgacagtaggggaagggggagaaaggaggaaagaaggaaaacagtgcctggggcatagaagccaagcagtgtatgcaactttccttctcttctttctcttctgaaatgctatgaatatgccttttaggtagtatccagaaatgttccttcctgaaagggtccagaaactactgaaaactgtacagattatgaaatgaaacagggtgcagggatttggatttgagttgatgtttctgcttttgaacaccagggggaatcttgggttacattaatctaggtaaagtgcagaatagtctcctgtatttcagtgccctctttccttcatttaactaactctaggttctagtttttccctaattcttccacaaatccccaaagtgtttatttataaagtgaagaattgctattttttaacactgttcgaaacaccttatctctaaaatgacttattctagttctctgaaaccttactttaaataacaaatccagcagtttctgatgaagtaaatgaaatgtcagcatattttaaaataatttgcctaatttgttcttagcataatgccagaaaagctttctggattttgtatcacaaaaggctagtagatttcagtagctatcaatcttctaccagcactaagtatattttaaaaactcagcattaaggtttatttttccaagtatgtttcagcacaggaaataaaatcatgctcctttggagtcccttaaatgctggagctgtttagagtgacatacaagaactttcttcacgttacatgctctctcttcctccatcttgcttttaactgttagcttacttctccaattcaatccacttcgtttgaactctttatcataattctataaaacttatgaaaatacagtcaactgcattttctgtatgtttctgtgtttcaatatcttcaaaatggaatgtactgccttggtacatcacccactatgaatctgttatttctgttatatcccacagttgccaggccaggatacttgtcccatccaggccaaacaccttcccccgaaagcaagtatgcatttgtccaccaggtccttgactctattttacattatctttttagtcaattcatttatttttatgccactcctgctgtcttggttcagtatgtccagggaattatcagaatttcttttctaaaataaaaatctgtttatgcttgcaattccttgacagttctcaattatctgcaaagtgcatccaaacttcttggcatagcatcaaagatctttctgtatgcctcttgcttccctttgcggcccctgccaccccactgcccacactgcattctagccgtgatgacaggcttgaattttcagttatgctcatgtctgtccatcattgtatttgttattcctctctttccaccaagttgtctgcctagagagctcattttccttaagaatttcttcacaaaccatctctactatgaagctcaagtgtgtcatgaagtgttagcttctccaacttgtgtttcttgcagacactctgtgcaagacattgacttaggtgctaaagagggaaagctagatattatattgttcttgaggttgaaagcttacagtctagtaggagagtcaactttgctgtctttacctcagtgtttttctccctctgtgcttccctagcacgtggtacttacatatttctggaatcttgattaaacacctgtttgaggactgtctgagcacaatccttctggattgtgacaccctcaagggagcagagatacaaagatggctttgtatactaaatgactggccctcatagatacctagtacatatttgtcaaataaatgaatgcattctatttttggaataattctattcagaatcagataaagtttactttaagctatgaagaaagaagtctcttagcaactcttacaataatcacaatcaaagaatgactgtttaacttaatataaaccagtttgttttaataaaatatttgacaatagtcatggttacacaatgcataaattatggctaaattattatcaggaaggaaaaatctttacttattatttcaaaagctattttgctagtctattaaaagctattagaactgcacttcttaagattaaattctataattgaacattttaactaaccaagatattatctctttgccactgacattatttcaaattaagcttaactatttctttttagcctttggaaagtattctgaaagagtctgtgttctataaatatacttaaagaggcatgtcttataaaggatttggatactattcaatgatgtatgacttggctttagcttttttattcttaatctctcagcttttctcttcagcaggggaagagtacctaatggcctttcagtaatcccttggtaaatttttctttcaagcccattacttactgtgaaggtcaacttcattagtgtatttatcttatttttttcagcccaaaataggtatattgaaatgaatgggcctaatgtcaaatgtcccgactacatcctggaagagagagaatcttcagctgtattagttgatgcagttaaataatatgtactctccaggccctcatacaattgaaagttcagggtatcgttgctgctctgcttctaatccttccagaagtgattggtgctaggtgatggagtaactattaattgatataatgtgagccaaaaccaacagtcacgaataagcaaaggatttaaatttaactccattaagtcttgtgagaaattattttcaacataggttataacatacctgtgacatcacatgaaatgctgtagtcaatttgacatcatggggcagagaagacagagttggaaatcagaattttatagacatctaatgtgataataacattagtagctgagatgcggtaagctctttgaccatgtttccagaatggataagacctggttgagatgaaaactttacactgtttttttatattaactatcttttactctttgcctgaaatgtccaactctagttgctcgtgattgcgtgggtcagtctccagaaggttggactttaatattacccgtcatcttttccaagacaaaattgtattcattctaactcttagccccaaattttcttttttaaccttaatatctaacatgattaggtttatggtaaattatatactcaaacagaagaagagactaatagcaagcaaaagtcttatattttcatttgttttcatccaaaaagtagaaaatattttccaaacattgggaaacattttagtcagaaaaataaatatcaatgataaatagaatagagaaaaattttaaagctgagctaaacctctatgtggttttaggaaaatcaaaactattaaataaatggcaagtacaacaaaatcccatcaattcttatttaacatacttacattttgaaatagttaaaatattcatatgatcattgagagaattcagaattgcctttaagtaattgttcacatatacaaaagaaaagtctccaaaaattgggtctttgcctgagatagatttgtcttaaaattgaaatcattcacttatcagatttgacccttttttaaagcataactttgctgtgtaatattagacttatatgttttgatttccttctacaatatctcttaactttaagggacaaagtgagcacagaatttttgatgcttgacatagtggacatttatatttaaggaaattaggacaaaaattattataatgtaatcacatttgaataagatttcctgtgcattttctggcagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccaggtaggtgatcaggtctgtctcataattctatcttcaggatggataaccactgacctcagatgtgagttcagaagagtcaaaaggaaaacagagtctatcacattgtgaacagaggtttattttgtgaaaaaatgcaagcatcacattgtgatttttatcattgtattttgtaggaaaaaaacaattgatgtaatttttcagggcaaaaactgaataaaaagaagagaatgtttgatatcaagttatatgttttaaagttagatttgtagattctttagatactctagaggtcataaaaagtaacagcaaaaactttagtctaggtattgttggcacttgtgaggcaaatcaaattcaggtccacaaattctttttcataattctgaaacccaaagaactctgaaaatcccaagattttttaaaaaatgactaatttggtgtcaaaacctaagcaagctgacttgttgcttattacaatctttatttctcatgctcagtgtgaatatgcatacattttgctgcagaaatatatacatgtttgagtacagggggctggccgtgaccctactgagggtttctgtacacatcactgtctaccctgtggaatcttacctccctttcttagttcccaatcctgaaaagcagttatggggccagtgctctgtacagacatgttgtctcagacatcagtttgagcaggaagtaaatcatttaggggttggcatttgtttggagtgtggggaacactctatctttagggaaactttatatagttagttatttgtaagtaaaattacaggtggctatacatcatcttgctgattgcaactcaattaaatcaccgtgcctggcacagaagaaaatatgctacaggatatctcactagggaaaaggttctagttcgtttcctgcgcactcaacttttgtacttagataagcaaatggccccagattccaatgcctggttttatttttgctccaaatacatatatactcttttgttttggatagttacattttagaagtagactgtgtattctcataaacacttcaaagtgtatgttctggctgagagtgtctctgtgttgttcaataataataagactaattatcattttttgagtacctgctgtgcgtcaggcccagtgccacgtatattagagacaagatctcttatcctcatgccagggctggaagttagctattagtttctcatttgccaaatgagaaaactgaggctcagggagattatgtaacttgcagaatatcactcagtaattggccaagataagaattcagtctaaatgagaaccagatccagagatatttggctttaaattctatagtctctcctaaaccatatgcaactctaacatgaagaagcttatttaatcttcactattaaaaaagtcaaaacaaaacaacagagccatgaatagcaaatattgtcaatgagaggtttggaaaaacagtcttaaaggatgaaattccatagacctgatatatttccacctggaaaaagtgggcatgggacagtgattttctcttgaaagatctgctcatttttgtcatgggacatgaaggtggactggaccactcagtttcttctttctgcatctcccaacccagtctttctgttcatggggtgaaaatctgttgttgaagccttgtctgcttaattggacagtggatctctcgggtccctgtgggctgtgcgcttgtacttgagctctgcttcttcactctgtggtctaggccagctagcagccagctgagttcaccttggttcagactcatggcctttcattttcagtatctgacttcctggttttgctgaaaacctgtctaaaatgtaatatccatctgattcttcataccaagccacacaattcttcctgatcccttttaatctccaatattgaatggtggtaacataaatatggagacagatcatgtcagaaacccagggcctaatcttttcttttctgcctactcttctcacaggctgcttagtactttgtaagctttttttttttttctggctgtaacctagattttctctttatcattactctatttattattgttagagcacttctgattatctcagccctaaactctgcctccaattttaaataacaataactcccactcctgctaatactgctactactactaccatcaccaaactttttcttccccaaagcagttctgtttgggaaggaaacagttccctctcatacaatttcagttatcttcttgtcttttccgtttaatgaatcttcctgttaatgttacatcttttaacatggaaacttctagagaaacaaaagacgatggatttgttaaaccttttgggtgtatttttatactaactcttactgcagcgtgtgcattatgagtgtaggtccattacggctgtattaggagcagaaccttccagagcatgagcgatgtgctgggcttgtgcttagctctatccatgagttaagtatctcaatccttaggaccctctgacatatgtgctattattatttctagtctatagatacagagactaaagtttagagaatataaaaaaacatttacaaggtcctatgggacaaaaactgtaggacaaaatgcaaacccaagcagcctgagagcagagctcctggtccagcactgtgatagctggggacgcagagacagaaacaatgcaattattgacagggaccatggtgctgtgtctgtccacattttgaagataattatggtttggatattttcacctttaaataacttggagagtttcaacattaactcagtcagatggatacatttatatcatatcctgctgggagtgacagttaattctgggtcctatggcaattgcacttttgactgagatgaatgctgactgatggctttaacatttaactaatgcgatagtatttaacacacccatataaatactatagtcttcgggtaaataaaatgttaccggctggacatacatgaatatctgatggagattatggaacatactctactcatacttctctgaaagtaaaaaataaaagatatgtttcagtacacaatgtgatatgtactcagacttaattcataaatttctcttatccttcatccgtggatcttttctttatttacttattgcgtttgttaaaatgcaggcttctctgaaaaattatttttaaaaatagtttttagacaatgaatcatattttctcaagtattttaacattgtaatcattatgataattatccaaggggaaattatacttattttttattcatttattcattcatttggcaacaatacattgaacatttactaagcatcaaactggctctaccacttaatagtggcatgatgttcatcaagaaattgttagtgcaatcaagaacactagaaattcattggatgaatttaaagaagcttttagaagggtattatattataattgaggcactttatgaatatataaataatattatgttttcatgctagagatcatgccaatgaagatatttactttgaaaaggagaagattagaagtttaaaagcatttccatattgaagtaaatattcatttccatatcttcacagttatctttctctgagttctctgactcattgtgaaaaaaaatcccaaccttcttcacagctctaccatcttcggattgttgcctagaggggtaaaaactattgtaaaaggatgtgtgcactggatgagaatttagaattagacgaaatgacccctagagtcttttcctgctttaagagcctgtgattccaaattctaacagtacatttatcaagaaaaaatatgctgaacatttaaatagtttttgaatagtacctagatataatagatacctaataaatgtgctcaatgaataataaataactggttaagatttaaataagcctccaaaatctcttccacattctaagaagggaagcataaaggttgttaatgaactagtgactgtgtgggtagctcattatttttaagtactcttgactttgctgttcattatctgtgtggccttaggaaaatacacacatttctgaaaggattatgtcgtttgtaaaatagaaagtccttatctgtctaccacagatgattcttatgcaaatcaaatgaaatgttcaataaggtgtctgtaaaatagtagagagagatgaattaggagctattgtgatttgtttacattatgtcacaggtgcactttattagggatatgttttatcttaattacacaattctttaacttagattttgagaattatattatggttatataggaaaatgcccttattctaaggaaatgtataatatatttaggtctgaaacattgtatctgtaacaatatagtatgtaaattatgctaattcacatgataattatatgtaattatattaatatattactatgtatacaatatatttacatgcatatatgtggggaaatgttatcagttagtgtagtaggggttatcatactcaaattcgatgtctccatccttccaactcttcatgcttttccagcatggtgaggactgctgagctccatcttttgctggtagtctctctgtcaaatagaactgtttccaaattcagtcatttgctccttgaaggctatgaattcatacttcgttatatttttctggctgcatatttaaattactttaacaatcatataagttcattgtaaaaattttggaaataaaaaggaagataaaatgcacagataattttagcaaatgaaataataattatattgggatgtatttcttcctagattttaattatgtacattcccatcaactttttattttgaaaatgtttaagcctaaagaacagttgaaagagtagtacaggctgggtgcagtggctcctgcctgtaatcccaacactttgggaggccgaggtgggtggatcacttgaggtcaggagttcaagaccagcctgaccaacatggtgaaaccctgtcactactaaaaatacaaaaatcagctgggcacggtggtgggcacctgtaatcccagctactcgggaggctgaggcaggagaatcgcttgaacccaggaggcagaggttgcagtaagccaagatcacacccctgcactccagcctgggcaagagagtgagactccatctcaaaaaaaaaaaaaaaaaaaaaaagaaagaaagagtagtacaatatacattcatactcatatacccgacgcataaattcattgattatttactttttgccctacttgttctttcttgctctctttgcgtatgaatgaatcattgaaattaagttgtagacatcatgccatatcacctctgaacagtgtgtatatttctttagaataaggatgtttacttacataatcataataccattatcacagctaagaaaattaattcagttgattttttccacatatttgataactttctgtctatccacgattatgtcttacatattcttttaatttatgtcatagcatatcatcttagaaagtgatccctaagttactgcatggtatacattgtttaaccatttccctttgtgattggatgtctttaggttgattatatttttattattatcacaaatgttgaaatcactctttttttctgaagaatttaaaagtaatttatctgtcttatggaataaaatatttatttccccttaaaagaatttcaggcatgaacccaagagagaaggcttttttttttgttttagttgttgtttttatttttattttttattttttgggtagaaggagcagagagacaagttcaggaaataatgagagtgttagaattttgttcaggttaaagtgagttggagtgaagtttagaaatctcctttctactcatctctcctgtttttaaaacactgtcctggaaatagttaatattaggaacgagaaaaatggtataggttttcctagtacactttatttcttaattatgaaattctacttaataacttaccattgaatgtttatccttattatcattcaaggtaattttattgaagattgaagatatttataataaagattgaaggattttattgtcctgtgtggtcaaccttggggggtgagatgttatgagacaggacaattaattgacttgatcaaggtaccttgttataaaaataacacagcctggtttagaacatctcttcctgactctcttatttggcatatagcctaagtgtatgcctccttggatgtatgagccctgatgttggtcatatttattattttatctgcttactttcagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctggtaagttctgttttctctacaatgaagattttttttcttaatatcagcagcttcatttttatttaattgtagttgtatgcttaattccttaaacagatgatcattttttttgtttagtgcataaatattcttaaatcttgtgatatattaataaaaatcacctgaaaaaggtagcagttttaggctttttaaaaaatccgcaattaatattggtgtagttaatattatatttagaaacatagagaaggaaattgctgttagaactccacatttggtgatttttaattttcataaagaattactgtgtactcattatcctggaatgttttcgttttcttggagtgaaataatttacatgcaggaatggaagactgaatgatctataataataatttttcataagaatcggtaaatgtgtatttaatgttatcaaagctcatttggaatggttgtctcatgctttcaagaaattagaggactttgtaattcattccttaaccattactttagttctcaccacaaaataacattttaagtttatttagctctttctcatattttctgctttccctttcatttaaaaaatacttttgagtgtacacaatgtgccatgtacaggaaatagagctttatcttttttgggtataacttcaagatcatggcaaaagaaaacttattattaattggataaaccttagatataatctaggttatttcccttattttactagttttctagtgaaaatattcaggtctctgctgggtacagtggcttacgcctgtaatcccagcactttgggaggcccaggcaggcagatcacttgaggccaggagctggagaccagcctggccaacatggtgaaaccctgtctctactaaaaatacaaaaagtagctgggcatggtggcatgtgcgtgtagtcccagctaccaaggaggctgaggcacgagaatagcttgaacctgggaggttgcagtgagccgagattgcgccactgcactccagcctaagcaacaaagtgagactccatcttaaaaaaaaaaattcagttctgtgttctgcatcaaccagaataagctacgcctcttataaaaaacaaatgtgcacaaaccatctgtgaggacataaggattaaatgcttgcttactttgagtattaaaataaaaagtagaagctttattatatgagtaaaagtgtttccaaagtctatttgaaatgcaggtacagaatgaaaatctgttattttattaaatcgttatttgggtctctttttattccataaaaaaaaaatcttttccacatctcttagtggagatcaagttaacaaaattagctttaattttgtgacaagtaaatttacataaatataggattatggagataatatttttctttgcaatgtctggaccttttataaacattgagaggaaatataaccattcttacttatttagtatgctagcatgatgttttttaatgttttagatccagttaaagaatatggttgtgccccatggcctatggttgagaaattaattaaacagtgtttgaaagaaaatcctcaagaaaggcctacttctgcccaggtattcttaaagttttgttaatattttgtacagaacatcatttgcatatatgcatatatatataatcttcaaatatatatacttaaacacataaacacacagagacagaattaaaaatagttataaggcaaacctcctataattttcaccatcccaggcacaaaaaaaggacattgccaaaacctcacatgctcccatatgcctgtctcctcttctcttctttgaaatgcctgcccattattttgcccatttttctgttgactcttttgcctacaaatcaaatcagaaaaaaatttttatatataacatactaatcctttcttggttttatatgttgcaatttctttttcgagctggtggcttgctttttaaatttcttgtagggtgcccgttaatgaatggaatttcttaattttaatatatataaatttaacaattcttctttttccttcttttcctggttattcctatttggtcctgttgtagagcccatctttcttttagagctacaaaaatatttacctgcaatttcttcaaacattttaaaagtttgcttttgacaagattttaatccattggaattgacatttttatctgtatcccattcctttttttaatgtggaagactaattttttcaggttgatttactaaatggcttctccccttttgtcccatagatctgatgtgtccattttgtaatttattaaagataatgtgcatatccacgtgtacactgtcttccactgatcaactcatttatttttcctccagtattaccctgtcttaattcctgtagctttataatgatctcctctccctatttatttttctcatccaggaatattttaaccagtcttaggcttagcttttctatataaaatttagaatcatgctgtcaaatcttatgaaaaaccacattgtcgtttggattggtcttggattgaatatgttgacaatctggagatgatatccttatgatattaagtctttgtattctttttcttatttatttatttatttagaggcagggtctcactctgtcacccaggctggagtgctggagtgcagtggcaggatcacagctcaatgcagctttgacctcctgggctcaagtgatcctgtcgcctcagtctccatcagccaattgtgtgccaccagacctggttaacttttcctttaatttttttgtagagaaagggtctcactctgttgcccaggctggtcttgaactcctggcctcaagcaatcctcccgcctaggcctcccaaagtgcatgagcaactgcacctggccaagtcttcctattctggaatggcatgaattctctctgtttacttaggtcttctcaagcgtctttcaataaagttttgtaatgctacatacaggtcttgcatatcttttgctggattttcttgctgcaaattgctttaaatgcagttcatggcttgagatttgttttttaactgcccagttaacgtaaatctggtctatgaattgtattgacaacaagcttgtgagtagcaatttttcagcaaccttttgctccctctccccgctccctgcacagtcccagaacaactttccttatataccaatgaaggtggaaatgtggacaggttgatttctccttcttgtttatgctgaatatgcagtcctttggggtcccagctttataggtacagtccctttactaagactgtctatcttgggaaggccctagactccaacttctctcccatgggccccacaaagcatccaagagtatacatttatattatctcactttgtcttggcagacaaatgtcttcagggcaagtctggctttaggggtccactgacctctctggtttctgtctctcactgtgatttcggcctgataattccttatggtgtcagatcttcaatgtttttaatacattgtttttaaaaaaatcatttagcattttaaattgtttttagttggaagatttgcccaagtaaccttgtccaccatattatctgaaagagaactcttgtcatgttttacactgatacacattttaataaatgtgggttatctttatgttgtgagctcttgatttggtattataattaattggaaaagttttaactttaagtattctgatcaaaatagtcaagtacaactataatgactttatcaaatattacataatttttcttctacttggtttacttgttttttaatttaggttaccatcaatgttagtcacatgaacttttatatttatgtccacagtaaaaatttttcatagcttgttgtttttctttcttgttttttcattttcaattatacttcacctatacttaacagaatacttaacaaatatgtatatatatgacaatattaaaaagcttagacatacttattttatgtttaaaatataacatatactaggcaagacaggaaaactcatcacttttatgaaatgaggcacagacagagtaatgggctttcttggtgtctcctgagtggcgggcaggtggccatgtcacagctctaatcccagtttcctgacttctggttctgttttcttacggtgccttcacactgtctctccagatcaaaaacagaatctagagatgacttctaaattttgttaccaaagactgaaattcctgttcctttcaactactagaagctcaactaaattgttggcccaagggtttttctctcactggcggtggctctgcaatatagaattgcatgcagagtacctcctgactccgctaaaatcctgtttaattgacccttgagattttcttttcaagttaaaaaaaatactacacataccaaagagtatcaagcacagtttaaaaatacatatttgtcttttcatgtaattttatttgtagtttagattactaatcttggtgatctagttgggttccagtttaacagttttaggttttgcttgacagagctataacacttcagtctatatttgatttttcaagggaaatgagttaactcgataagtactgttttgttatctttaaactttctcaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggtaaatccaaatgctctttaaatctttcataatttaaagcatataccatttggaaagttacttaggaataaattaaataagagccaatgtaggattattattcaattagccttctgttagaacaagagtattcaagagcaaatgtgttttgctttagaatcacagcatatgtcttagctcagggtccctagaaacagagcctgagatgggttatcttgcacaagtgatttaaggaaagagaatcttagagagaagtagaggaagccagaaagggcagaggaaaaagctcagcagaaatgtggtttctgaagaggtccagcctcagtctctgcccacaaggagctctggaatatgaataggagcacagaattttcccactgccaggcaagggagccagtctttcattctcacatattgttcagtcattggctgcaatctgctgggaggtgggggtagtgtaactttcaaggcatttctgggcaagctgcctcctgtcatctgagggtattctgtgataaatagcacatctctgaactatagtagccaacactcagggtagctggggatggcgtacctgatggataaaggagatctggacatggctcctaaaagtggatcaatacattgtgttggcaaatataagataagtttctagacttcaaagacaacctagtattttgactgctgcctgaagataaatattgtgcctcaacattagttctgaggttaaacaatcttttttttttaattgatcattcttgggtgtttctcgcagagggggatttggcagggtcataggacaataatggagggaaggtcagcagataaacaagtgaacaaaggtctctggttttcctaggcagaggaccctgcggccttccgtagtgtttgtgtccctgggtacttgagattagggagtagtgatgactcttaacgagcatgctgccttcaagcatctgtttaacaaagcacatcttgcaccgcccttaatccatttaaccctgagtggacacagcacatgtttcagagagcaccgggttgggggcaaggtcatagatcaacagcatcccaaggcagaagaatttttcttagtacagaacaaaatggagtctcctatgtctacttctttctacacagacacagcaacaatctgatttctgtatcttttccccacatttcccccttttctactcgacaaaaccgccaacgtcatcatggcctgttctcaatgagctgctgggtacacctcccagacggggtggcagccgggcagaggggctcctcacttcccagaaggggcggccgggcagaggcgccccccacctcccagacggggcggcggccgggcgggggctgccccccacctcccggatggggtggctgcccagcggagacgctcctcacttcccagacggggcggctgctgggcggaggggctcctcacttctccgacggggcggctgctgggcggaggggctcctcacttctcagacggggcagctgccaggcaaaggggctcctcacttctcagacggggcggctgccgggcagagggactcctcacttctcagacagggcggccaggcagagatgctcctcacctcccagacagggttgcggccgggcataggctctcctcacatcccagacggggcggcagggcagaggcgctccccacatctcagacaatgggcggccgggcagagccgctcatcacttcctagacgggatggcggccgggaagaggcgctcctcatttcccagactgggcagccgggcagagggggctcctcacatcccagacgatgggcggccaggcagagacgctcctcacttcccagacggggtggcggccgggcagaggctgcaatctcggcactttgggaggccaaggcaggcggctgggaggtggaggttgtaggtagccaagatcacgccactgcactccagcctgggcaactttgagcactgagtgaacgagactccgtctgcaatcccggcacctcgggaggccgaggctggcagatcactcgcggttaggagctggagaccagcccggccaacacagcgaaaccccgtctccaccaaaaaaatatgaaaaccagtcaggcgtggcggcgcacgcctgcaatggcaggcactctgcaggctgaggcaggagaatcaggcagggaggttgcagtgagccgagatggcagcagtacagcccagcttcggctcggcatcagagggagacggtggaaagagagggagagggagaccatggggagagggagacggagagggagagggagaggaacaatcttcttatatggtttgaaggaatgagaattcacactgaaaaataatttttaattttagtttcagatgtcatcttgataggcaaaacttgtctgccaattaactcatttattgctgaaaattaaataaaattggcattgtttttaaaagtaatgcaagaaagcaaaaagagttatgttgataacagaatcctttattctgtacaagttctagttgcttaagcttaaatcaaatcctgctaagtatattttcttttcttaacaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaaggtatggtagtgaatttgatcaatggggaaattacagatcttttaaacgactgaattgtgtgcataattgttattgcatcagcaaagattgttcatttttagcctattttcattggtttgcatatattaaagggaattgtggaaggtcacagagatatttgttgtttttctgaatacagatctagctgagacatttataaaataagtcaaccatttattcaggcctaccagccctgctcctggtattacctcaactgtggctctatctctttacttctcctcagatcaatgaatctttgtagggcctcttcaaggataaattctcattcattcattctttgaaaaaaaaaaaatatatatatatatatatatgaaacccattgtgtgccaggcttaaacataccagttatctaactaccaaattaagaaaaaaattaaataaatgaattaataaattcttaataggtgaaaatgacttagctcttatcaattgcagggttcttgtcccaaagaaatatatctacatagcaaaatttcaggtgtgagttgtaggttggtgactgtaatatttggggcaggatgatttccaggaggcattaagattataccctatatatttctctggtttaagttagtattggaaaaaaagtactagaaaaatgtgaagcctgttttttgtacctgaaatatcaactccactggcagtttcggagttgaaattatttgaatatggtcaaagaaaaatttcaatggatggaattgggcaaggacgactttattcaagcctatcacagcaggggagagagatcagactgaactaaactccactgaaacaaaaggtgggagagttttaagcgcaggggtgagctaatggaaacgtactggagcaccttgttggaaggaagtgggagcagttgtcaatgtgattaggccatctgtgtttgctaattgtcccttattgaaggtaggctcctactctcccacagacactggggaattccttccttccttccatccctccctccctccctccctcccttccttccttccttcttcttttttttttttttgaaggagttttgctcttgttgcccaagctggagtgcaatggcatgatcttggctcactgcaacttccacctcctaagttcaagcgattctctagcctcagcctcctgagtagctgggattacaggcgtgcaccaccaaacctggctaattttttacatttttagtagaaacgggatttcaccatgttagccagactgatctcaatctcctgacctcaggtgatctgcccaccgcagcctcccaaagtgctgggattacaagtgtgagccaccacgccaggcctctgtcttgataattacatttcaaaggaatggctcccaggtccttggaaaagacattcttggggtataaaactgggaagagtctgggaaaaggggcagagaaagaatttataattccaagtcttctaaagtaaatactctaagaaaagggaggttaggaatttatagttgagaagtctatctaaagtttaataaagtggaggagaacattaaggccattttagtcaacatacatgttctttttgtaacaatttcaacatttttccttttagcaaacaaaaaaattttcttttggttggaaccgctgatggcaagttagcaatttttgaagataagactgttaaggtaaatgttgaatgcattctacatctaaatttattttaagtcttttgttttatatatatctcacacccctcttatgggattataaactccctgagagcaagaatcataaattatgctgtatttgtattgcttcataaaatcttgaacacagtagatcctctgaaaatacttgctgattgactgtatattttatatgaatgaactaagaataaaatgataaatgacatctgattgataatattgggaatggaaataattcaatttgtacataactgaggcagataattccttataaatatattgtggaaaaaaaacaaaaatatacttaagttttaaatatggcttgccattaactttttcttaagcattgaagaaatcatttaattttcttttcttcagattcctatttagtcattaaagcattcatttctctatccatctattcatctttggttccatctattcactcaacttcctacccgttcattctcctattgccaaaaagcttattatctgatgagagacagggaagtagagtataacccttaggttatttcttttgtaatttttacatgggaaaaagaatagattgaatgtaacaataatatttcgaatatgacctaaatttttttatgtataatatttgtacatatttatggggtacatgtgatatgttgttacatgcatagaatgtgtaatgatcaagtcagggtatttaggatatccatcaccatgagcatttatttctctgtgctgagaacatttcaagtctcctagttattttgaaatgtttttaactgtagtcactttattgtactattgaacattagaacttattcctcctatctaactgtatgtttgtacccgttaaccagcctcccttcatcctccccttctcccacacacccatatcctcccaagcctctggtaactatcattctactctctacctccatgagatcaacttttttagctcccacatatgagtgagtacatgtgatatttgtctttctgtgcttggcttatttcacttaacataatgacctccagttccatccatgttgctgtatatgacatgatttcattcctttttatggtcaaatagtattccgttatgtaaatacacacattttctttatgcattcattcattcatgggtgcttaggttgattccacttttttttttagctattgtgaatagtgctgcgataaacatggggatataggaatccctttgatatactgattccctttcctttagattagtatcagtagtaacattgttggattgtatggtagttctatttttaatttttttgagaaatcaccattttgttttccgtagtggctatagcaatttacatacacaccaatagcatatgggcattcgtttttttccgcatccttgccagcatgttattttttgtcttttttataatagccattctaattgggtgaagaagatttcattgtggttttcatttgcatttttactgatgattagttaatgttgagcattttttttcatatatccattggccattactatgtcttcttttgcaaatgtctatttagatcctttgccaactttttgttttgttttaagacagggtcttgctttcttacccaggctggctcacagtggcatgatcatagcttgttgcagccttgaccttctgcactcaagtgatcctccaacatcagcttcacgagtagctgggactacaggcgtgtgctaccatacctggctgtttattttttgtagagatgcggctccactatgttgtccagactgatctcaaactcctgggctcaagcaatcctcctgcctcatcttctcaaagtgctgggattacaggcatgagccaccatacccagccctttgcctacttttaaatggagttcttttttttttttcctgttgaattgctttttcgagtttcttgtgtattctggatgaatagtttgcaaatatttcctcacatttaatggatcctctctatattgttgatagtttcctttgctgtgcagaagctttttagtttattatagtcccatttgtctaattttgtttttgttgcctgtgcttttgggatcttaaccataaactctttgtctagaccaatgttctgaaatgtttcccctgtttccttttaatagtttcatagcttctggtcttacatttaagtctttaatccatcttgagttgaattttgtaaatggtgagagagtggggcctactttcatccttctgcatactgatatccagcttttccagcacaatttattgaaggtggtattctttctcccatgtatgcttttggtgcctttgttgaaaattagttggctttaaatatgtgggtttatttctgggtcctctacattggtctacctacctgtgtttttgccaatactgtgctgttttggttactctagccttgtaatatattttcaagtcaggtagtgtgatgcctccagctttgttctttttgctcaggattgttttggctattttggctctttttcggttccactcaagttttagaaatttttttttctatttctgtgagaaatatcattggagctttcatgggaatttcattgaatctgtagattgctttgggtagtatggtcattttaacaatattaattcttccagtctgtgagcatgaatatctttccatttgtttgtgtcctcttcaatttctttcatgtttttcaggtttccttatagagatcgttcatcatctttgttaaatttactcctaggtattttattaattttttgtagctacttcaaatgggattgctttcttgatttttcagctactttgttgttgttgttgtatagatatgctactgatttctgtatgttgattttgaatcctttactatactcatttatcagaactaagagttttttttaatggaatctttaggtttttgagttttaattttaatatctctaatcatttaagatggaaagtagttttttgaaagcacagattttatggagttttgttctgtggatactcaatttgctgagtgtgttttcttttttttttggcaaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgtaagttattttttatctgtacaagtaatttatcattatacttttgttttttccttataatcattaataatactgttgataattcataaggaagatcttttaaaatgcataatttattttctatcataaaattaaactttcattataaaaaattttgaaaattccagaaagcagaagggtatttttaagaagtcactcaacctaatcacttttagggataaaatatgtaaactcattgtaatcttagtagtatttatcaatctaaattttttaacaatttttattatctgtgtttcaaattagacatgaaattggaagacaatcaactttgtatttcaccaaattcacggactatacatatgcaatttgggtaacttccattaagtattgattgtaggaaagatagacagcaagtattcttgcttgtccaaagttgtttctagatttgataattatacagatgtctactcacagccaagttagtgataccagtttcaaacaagaataaaataaaatattaatataaacctctttcaagtttgctttttttcagtggtattttaatcaaatctttgcagttggttcttatttatcacattcctcagtgataagcagtataggattgtggataagagcataaatcatagttcagatattgctttgccatctattggttttgtgaacttgggcaataacctttcacatcttcagtcatctcttacctgaggattgtaatattctctatctcaaagagatatttggaggagtaaataagaatgttaatatatggatcttaattaacataatgaccagcacctggtaagctgtcaataaacattagctattattattattattagctttgagtcacaaatccctaccttagggaatatcctggtttcccattatccatcaaatttcccaagattggcacttgggagtaatctttgactcctttgttttttgctccctttatccacttgaccctcctaattgtcatttgaatctttgtacttctcactgttctcagtgctggtaccatgggccagactgccatccattatctgtggccacattaacaagagcatccagttctcaccctctgattatactctcttcaacatattttcagcattgcagacagagggacctttctaaaatgtacatcaatctgatgcaattttcctgcttaaaacccttcagtggtatcccattgtcctttatatgaagtccaaattccttaagacagcctactgggcccttcataattcagtgcttgcttacctgtctagattcatattttgcaagctttttgccatctgtgctttacccaaactgaaattgactcagatctctaagacaacctgttattacctttcacccccaacctttgaatgtggtcttctccttacctggatgactattatgccccctgcctatttcagtccaagcaccacttgctctgagtggcaggttaggtgactttgtgcttccattgcatctaatgttttccttcacagtagctataattgtatttgttaaagtagtttctcaataccactaaatctactggctttcaacattggctgtgcatttagaaaccactaggtagctgaaaataatatgatacctgggccctacctcagaccaattaaatcagaccagttaagcctgggatggggatcagattttttttttcaggttctcaagtgattctaaagtatatttgaggttaagatatactgcggagtgcagtgtattataagttcccatgaatgaggatttttatttctgtctttacatatttatttactagtatgtggttaacatttggatcaactcattctcattctgtaatacccacattttaaaaaatgaatgtaaaaatgtcttttattatttttatttttcaaatttaattttagattccaggaatacatgtgcaggtttgttacaaaagtatagtgcgtgatgctgaggtttggaatacaactgaactcacaacccagaaagtgggcatagtgcttgataggtagtttttcatctttgctccccttcctgtaatttccacttttaacccaattatacaagcctgaaaacctttaaaaagaaagggcctccagtttatttttttatttcatagcacattttatgggattatggatatcagttaactctttaaagttccatataagatttggagcatagatgctttactagagagcatccataaagatcaagctctcaaagatgctcatctcccaaaagagattgggacctagatgcataaacacttaaatataaatatttgctctcttctgaacaagtatctcctgtggccttggtctctaccccacaaaacagacatcacatcactaatcaggggttgcctcatcatcagtaccctcatcatcatcagtacacaccgactgagaggcatgttgggtaatgaaagatgactgcctttgaagccggaagactccataggacttttggagttctaggtctgcaacatgtttttagtcctaggtcggcaagcatgatgttagtcataggaccttgagcaaattatttagcatttgtacatgtttctttctactattaaaaacattgagatttatcatattttatgtttttttattaaggatcaagcaagataacacacaaaagtattttataaaatacggaaattccatgcaaaactttgtcctaattggaactattttctattaaatacagcaaatatccaagaaggaattacctaaagcgtagtggctctctgacaacacatcatatttttacctccttttccagaatagaaagaaaagggggaggaaaaaaaatcttcctactctaggatatactaatgattgttaaatctttatggtattttcatgttatctatctgatttaaatgcaattttgactatttttacatattcctcgttgttcattcatactgtagtgccttcttctattcccccacttaacagactgcttgattatatcagaggtgcttatctgtgcaactgtttactggacgaggggtatgtagaaaatacattgtcctcatccttatgaaattacactcataatctagtgtgagggatgcactaataaagacaattttatatttaataaggtctataatatgacagtgacaccagtggggaaaagggactggttggtctattttgataggtcagggaagaaatccagaggagccgacatttaagttcatcctcaaaggccaagtaggagtttgccatgctgatgtggcccaaggtagccaatctgtttgtgaaatatgtacaatgccagatgtcttaggttgaaagggaaatattttaaggtgttcgtaatttttctttatgtttaaaaggggaaaatggcaaatattttactttctgtttatgtttggatgatgtggatttttgttttctataatttgactggcttaactgcaaagatatcccttgctttaaaatttgaagacactgcaactaaattttatttcagcattttatattttataactctaggtataaaaggctaacacttaattttctgagcattcatgaaacaaagttttgcaagaacattcaaaagttacagatataatatttccttcagaaatttagatatagtacaaaattctacaaagagccacatagaattgaaactaaaagtaagaccaaagtaaacattggacataatctttattttattatcacaagaaattaatataaagtaaccaaaagtaagtaaagtaccaaagcatgttatatattcaattcagaatggttagggaagaatatgaaataattgcaatagtctagcttgtttagttttcaaaatagtgtttttacattaagaactaatataaggttgtattacacgtagaaattttaagaagaaaacaaatagtgatgactttctatttttttttctctgtaggttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaaggtaaattctgtggtttttaattttattcccaaaagaattatctttgcacttcatgtgtcacagaggaaggatttttcttcctttctgcctctgaatagagaatttttttaaaatgcagaaaaaaatttgtaatgcttctcagcaccatcttttcagatcaagaaaattttgtcttcagaacataaaagaataggcacataatgtgcatagttttctcatggtattacaaagaatgttctcgaatgaaaatactacattattgaaaatgagcatattggagtctctgctagctttgacatagttctgtcacagtgtcaaatatactatttataattaaattatgggccccaggattatctgctctaaagaaaaagagtcacaaaataatagacaaatatggggggaaatgcaatggactgaccgaggcgctaaggagtggggatcaagaccccagaatgagagcatagtgcttagtctgatgcagcctgtgagtgacaaatccatagcaagcacattctttctgtgctggtgctgagaaacaggaccattttcaagcttatttgctagccactttatatttttattttgttttgattttaccatatagatctatgatactcttgagaacattttagattacacactatatctgtaaaaggatacttcaaagtttcctgtcttagattcatctgacagtttttctatggattgtgagaagggctcacagtttatgttcagaagggccaacaggtctccttgataaagggttccttacttcctgaagtaccaaaacgattaggattcttttatttctggacacttcatttttgtcatgaattagactattcactggttctgggaaaaaattcagtggtttgtatcgatatcttttacatgtgaatgactataattttatgttcctttgtaacattgagacttcatgtaaaacttttgactctaacttttttttttctttatcctgggcacatgtatgctatttttactgaattagatagctttggtatttataaaaattgtatccctcttattcataatttcctgaaaatgaagggctattgttatctttgataatttatgcttcaagtaaagaagtgtggctctttggcatctgtatttagcaaaatttgctttgtataattttaatgatgcataatggtggtggtgtcatgttttaataatttaaaatgttgtttatgttatcatatgtaaatagcatttatctcttaattggtggtaaaattattaatgtatactttatggttctagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggcaagtttctttcctttagatatttttcatattctctaagtcttataaaatatgcctttattttacgtttacattttctctgaactttccagtgtcatatggatggtcttggagggtcacacagtgaaacataagactggtataaattgtgaatagggtcattacagaagtggagggagtaaatgctctcagtcccacaagagaagcagattactgcagctgaacactcagtttgggtcttacttgcttttttcctttttacctaaggcaaaaatgggaaatacatggtattgaatatattttactttttgagcaaagaaaataaagaaaatgtttgttttaatcatagtctagcctcccagcttgttaaagaatctcatttggtttttcattctataacaaatcttttttcttgcagcaatacatgctgaactgcacaacctacaaatattgacaaatcatattttactcaaactttgtctttttttgcttctatttttatatttaaatatgataaaattgtgatagcacataaaatatattttctgcataaatatatttgcgtcttcctttgataataatttgttttagaaaataacaataatagcatatatacaaaagtttacaaaaacgacactatggggtttaattctgaaaaaaactagaatttatgtaactttagcaaataatgaatgttttgaacatggtgaagaaaatatattcattgcaagtatatgtgaaagaggaacatgtgtttttctagcaccttcacctatttttcatttatagactttagagttgcacaggagttacaattagatgctcttaatgactgtaaactattaagatacatgtccacacaagcagagcagtaggtctctcaataggttgtctcagtagtcttattctaccaaagttgttgcattctctagttgaattgtatgtactttgggacccaaatagcttgcttataactgaagttatagtggaatgtctatgggttatagtttgattttaaaataaagatcaattggaggatagcctacaaggtgctgcatgagctggcttcactgtacctctcctgcctccatcatctaccacattcctaccagatcttgcttgtctagatgaacatccagttcttctcaattactatgctatattttgcctcagggatttgcacatgctgtttatttctttgcttagttaacatagctttttttcatgcttatttaactcatatgctttgaaatgttagctcctgtgtcaaaacctctgagaagccaacactgattaggtcaaagttcccgctttgggttcccataacagctttcttgcatagttttgatcatggtcatatttttttttcattaatgctagtctcttcactagaatataaactccaagacggttgggttagtgtgtttttgtttaccccttttttcccaggatctagcctagggcctacatagaagacttttgatgcaaatttgttgaataaattagtgaatgatttgaaaagaaaatatgatattttgacatagtatcagtatatccatccatctaagtgtccatctaaatactcatatttgtactaaatactcatatttgtaccttaccatatccaaagaacttttcacacacattacctcgtttaacattgtaactttgggaagggtaatgtataaatactgagcctattttatagaaaggttaagctgttttctcagactcacataattaagaattgcagcaaggagtggatcacagattttgttattttttaaaaaaatgctggtctttattcaatataattgaagggtcacctagaaaatagaattgtgaattcagttccaaggtatttgtgtcttaaactatgaacaactttacttttttttcaggccagtttaatatatagttttaacagaaaacttacatattttgtttttgtaaaggaagccttaaaaatgtcatgctggtattgggctacaaccggaaaaatactgaaggtacacaaaagcagaaaggtaacatttagaaggatactgttttccaaacagggcaatgatgtgaatgatggtaacatattatgtgtttcataaatttgtagaaaatattacatatggtataatcaggaattttaattggtagtttatagtgtaaagaacttagacataaattttcaaaattacaagtgatatgaagtgttaaatatttatattttcagctgaagtagaggtgtcaatcactagctcaaccttaaacgaaatgtgaatattttttacaacttatctatatctacataatgtctaattttgaacagtgtttgaaaaagcttttatttcttttagaatatgaaatgttaatttattaaatgttgatactctatttgaaatttaatagtttctataatgtattataaaacttttccaagtatagttttttataaataataatttagtacattagttatagctgtgtttatatttacatttatctaagtcaactaaaaatacatgagccaaactgaaataaaataagaatgttttatgatggatctttgaaacatgatttcatttttttctttttctagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaaatgcttttaagcatgtttatgaatttttaaactttgtgatagtgttttgcttttcacatataggtctgttatccatctcataggaaactttgtattaatttgtatatgggacattccacaataagaaagtgcaactaaagttttttccttgataacttatggaatatttaaatttaattttctataatacatatagttgccaggatcccaggacaaaatctgatgggcatgatacattctattttcaagttctcttaaaaagtttttgtaagtaaacttgtttgctcttgagtactgaaacaaaatataagactttagagcaaatgacatatacaaaaaaaaggcacagtcacttcaactgttttctgattagaagcctaaaataacttgctaattatgatcaaaatacaagcatattatcgtaacaaaatattcttttgggaaaattttgaattaagaaaagggagcctctttgactctaattctggtaggtactctatcgattatgtgtgaactatttcaactaaaacgcaacttatttttcatcaaggcagtgaaatatattgatgaaacatagcagaattaccaaaaaaagattgtcaattttcctaagttaaatgtaaggatgcaaatgttctaatattgaggggagataaaattcaaaaccattgggactttgcttctttatccatcactttgggtagctgaacacctaacctggtaaattgaatgtttttcatggaggcttatcagcaattcagtaaaatagtaaactatgtcaactcgggagaaactgacatcctcattctccatgctagccagtttctcatccagggtgtcattgtttctaataacaattcagaatctggctgcttaaaggcacctacgtacgtggttctttctaatttgtcaaggcatttggagtgatcctatcaccctgatttcaagcaaaagacagggaggcacctgacccaaaggcctgctgtctgaacacactctgaatgggtgagcagagatgtgctttaagatagaacctaaggtggttctctctatgtgctgccctcacactgctcttgatttctacccttacctgggaagtctctacttgatgtctgtcttaggctaagaaaaagagaagagaaagggaatgagtattagcatctggattctggggctgcttcttggcctctgtgagaatccactgtttcacagcaatcacagcctagaaaactagactttatggagtaaacaataggtatcattctgacctgggcttcaccacaatcacccactgaacactcccaagagaaggttgttaccatttatttatgaaaataccaaactatgtgatacatactctattagaagtattatggaaaaatagagaatatgtctacctggccagagaatagaggatctggatcacaaaaaaagtacaaatatttaagcagagacttaggacaaatgggcattcaacaatttaggacacatgggcattctacaatttccagagtgaagtaaacattctaggcagataaatcacacatgtgctgtcttaggaatgtgagcttattttgaaagcatccctatcaaatacgtgctaaaacttgtgacaagttcccattcctagagtacttacaggatacacttaagtgactgaagatgcaagagaaatatatatttgtgtatggatatagcattttatcattaattgagagattataaagctaatgagcttttctttgcagagggagtatttgttaggatgaaatggggagagatgtttcaaacaccaagtttatcttataggttaagaaatcctagaaggaatccatgactttatgtatatatacaatatatgacaagagatttccccatctcattacaaaatgagcacaaagtaactaactcaaagcttttgctattatgataaaagtttaaaaggctagtacatagcagaaatgtgatttactataacgggggtccaggggataaaatatttgcaagctgattgtctcatgttggcaatgttttcatttcctactacgttaggtaacacagatgagattgtacatcagagtaagaaggcaaccactaatagaagctgcatgcgggcaaaagactattctctgaccataagcttagtttagatggatccttgctgcaatcactaaattcataaatctgtgctagtattggatcaggaaatctctgcacaagcagataaataaaaactttctgctttggctgaaataactgcttttaggaaaagaaagagtatatgcttattaatatagcttgggatgtggacctctttgacgagactatacaattcaaggtagacaaagtatgcctaaaaataaatctaaaataaacttgtatattcaaatggaacatattctttaataatgtcatttttaagggctctgcatttattccataaatgctgccattattgttcagtttttcttaattacctgcattcactttagaaaacagaaaaaaaaaaaaaaaaaaaaaaaacagaaacagttgcaaaagaaagcagccagaaagaacatacatttagaattgaaaaagaccttggtctaaattctagatttggcat

SEQ ID NO: 3 - DNA, 149001 bp, Macaca mulatta
  misc_feature (13141)..(13231): n is a, c, g, or t
  misc_feature (32848)..(32867): n is a, c, g, or t
  misc_feature (76156)..(76175): n is a, c, g, or t
  misc_feature (90592)..(90814): n is a, c, g, or t
  misc_feature (120751)..(125689): n is a, c, g, or t
  misc_feature (127650)..(133006): n is a, c, g, or t
tcttgtttttatgttttcttattcaagattatataactattaatttatattttatttttgaagttatttttatttaactttttaatctatctggagtttgttttgatgtttgctgtaattagaaatgccagtattatttttttcttttcaggaagttagccaaatgttctagcaccattttattctccactgagcactgcttccatcataaatttgtgcctgtaatcttcattttcagtcttgttaactacctgaagagttgataaatcttggaattttagtcagtcaattaaacatttttgaaacctaagagaatactttaccttaacactgcagtagttcatgggagaatgctcccaacagataattcatattttcatactgcctactcacagtctggccaatatagagtagataataaataggcaatagatggatgaatgaattgtggaaattggagacatctttttttttttttttttttgagacggagtctcgctctgccgcccaggctggagtgcagtggccggatctcagctcactgcaagctccgcctcccgggttcacgccattctcctgcctcagcctcccgagtagttaggactataggcgcccgccaccgcgcccggctagttttttgtattttttagtagagacggggtttcaccgtgttagccaggatggtctggatctcctgacctggtgatccgcccgtctcggcctcccaaagtgctgggattacaggcttgagtcaccgcgcccggccggagacatcttttaatttagatttattttgctttggaagggaggtaggttttaatttcttgcaaggttgtaattcagtagaataggaagggagaaactaatgcagaggaacagaaggaatgcatgagatcgagaatgcctagaaatatttgagacattgattaagtcatcagaaatggaaacaagtttagaaacaacttagaaaagaatacactgtaggtctgataaatattgttaagattaggatttttttttttaaattatggaaaatgttatacagacagaatagtagaacagaccacatgaacccatctcttattatcttcaacaattaccagttcaaaaattgttattgttatctctgcctccacacatttcatcttttcctccaccactggatgactttgaaacacatcctaaccctgctaccatttcaactgtaaatatttcagcatgtctctgtaaaaactgaagactctacaacaacaagacatagacctaatatccaggttaagtaggaatttgttatcttactaatctgatgaaaaaacaaagtctagagcatttttattaaagtggtagagcatgaagaaccatctaccgggtgttaggagatttgcctgagttgaagtcctggctctcaacttcccacctgtgtgactccagcaaagctcttcacttctctactccaaatctcaatttcctcattagtgaaagaaggatacatagtagtagttttatccatttcagacttgtcatcaggattgaagtaacagatgtgaaaacaaatctaaaattgtgaagtagtaacttccagtccaatcctcttctttttaaataaccttgaggacagacacatcaactgaaggatagatcatctttgcctagccttgtttacaatgttcttgctaggtttctcttcctaaaaacacattacttaggtacttaacagaacaaacaatcaaaaaacgaaaccaaaaaactttggggttatagacacccatactcataagtaattctgaatgccaagagaagagtatttcggtttgcttctctcaccttttcacctttcatttcatgtaccctgtcctttgtctcagttctaatagctctgagagctgattacttttccggtgtcccacgtatcaggatcctgcctagtgcaactcaattccaaaagttaatttagtggccttttggtgaccagagcttcagataactcacagggaaacaatgtttatttcctctcccactaacagtcacaacaataataaaaaagacagtagcggggcaagttttgatggctaacctctctctccatcctttaaggggagaactctataaagagaatgttttcctaaaggggccatctgggcggtgtcctctttttcccagcgccctgatttctattcttagatctggagataggcggctttcatttttcctgctgccagttcccagaccttccctggggccgcaggatccccggctggcgggtcgaggagggtggccggccgggctgcgcactgcgcgcctccgctgcggggctccgggccttgggactcggcggagtccgctgagtcagtttcttcctgcgcgactccccgccgcgccgccgctgtggtggaatctggtcccaggaggcggcgtccgcccgggtccagtctaggcgtgcgtgggggccacgggcacggtcatcccggccaggcccggctccagcagccccacggccgccgccgaagttctgcgcggcccgtcgccccggcggagcctctggcaggcccctgagctggttttttggggcctggctgggggaggaggaagccgagcaggagggctctggagagggagggcaacgcggggcggggagccaccgccttcctcataaacaggcgggcgtgggcgccgacggggcccccggggagccctggctgagggcggtgagctgagctagatcccggggagctgtggccggcgcccctgccggttccctgagcagcggacgttcgtgctgggagggcggcgggttggaagcaggggccaccatggctagtggcagctgtcaggggtgcgaggaggacgaggaaactctgaagaagttgatagtcaggctgaacaatgtccaggaaggtaaacagatagaaacgctggtccaaatcctggaggatctgctggtgttcacgtactccgagcacggtaatcacttgcgaagaaactgtgcttttgtttttgcaaactttcgccccctcctcacatttgcaaactttgtcctcctccgctgacgctgctcaaacccggactcttaaagagccgtaaactcccatctcctttccttagggcggaaaggagctgagaattccaggaaggtcttcacctttttgacttttctccccttttcagacttaaaaggaaagggggtgctgtggattgtgactttgcttcttttccccacccacttgttttccagcctccaagttatttcaaggcaaaaatatccatgtgcctctgttgatcgtcttggactcgtatatgagagtcgcgagtgtgcagcaggtaaaggcattgttttcacttcaactcattcgcccttctgtttggaaggagacgttttactggcagtgttatatagccgggagttcttggttattctggaaatttggcttgaggaacctccgactgtgattttcagatggggacattgttaaatattttgatcatgtaaaaagggatgaagggccccagtatgtgttccctgagtgtctttaagtagtaactttataaaaccgacagtatgggtggtggtagaagggggataaaaatgggttcgggtttagtcccgttattggcaagatgaattaattactgtttagacctgactattccaggaatcttcccaatgtagaacatgtcctagatgagaggattatgagtagtttggaaaaggggaataactaatagtgataaaatgccactttgtcactggcaaactcttgtagagttcagcatttcttaaaattcaaagacagatttctagcctttagttttagtataccttgtagtatctaaagaaagtcatgtcttttgagaccctcataatttacaactgttgtcgtataaaatgcatgtaaaactgaaacttttacaatctgtaccacaggaaacccagaaatttgctaaataccttggatatatatttttttaaggggggctttaaaatggtaattaagaatgatttacagtcaaaacaaaattataggccaaagtgataacttcctttggagtacttagagatttggggaactgaaatcagttttgtcatctgcatgttaactcatgcaaagaaagagaactggactttgaactccatggaggtgcagtcagaaagccaatgtttcttaatacttgagaggcttgacagaggtaaggcatctcaatctttaaattggtgtgggtctatctttatctttatgcttatctctgtatctagctctatctgtctgggtgaaccatctagcttctttcatatgaggacatttatatctggaagaaatattttaatttgttttcaactgtgaaatattttccatctgactgttacagattttcacaccactatcaaaccaaaccaagaaaagatggaggcataataaagatgctgttcttttaagactcaaagtcggaattttgcctgtggaatatgagtcactctttgggcaatggcctattgtgcttcctgctctgcacccacgtcatcccttcttgcctctgctttggtgttcggaagtgcctggttctggccactttcattccctagactctgtacttcatagagtcacttctgcttgataccgctcaggacagtcagaccctaggtaggctttggtctgcaaggtctagataagggagtgctagacttgagaacccaagggactctggaacataccacctaattcttaattttagaaattgcacaagcctgagcatacttgtctggagtagttatgagtgtgtcactcagtatttctgcccagaggatactggaggcaaagtatgctggaaaataaggaagagtctttttataagtaattaattacttttttggatgtatcatagttgtatatgtttttggggtacatgtgatattagatacatgtatacaatgtgtaatgttcaaatcagggtaactggactatccatcaccttgaacatttttctttgtgttggcaacattacaattcctttcttctagttattttgaaatatgcaataaattcataatttccctactgtactattaaatacgaacttaattgcttctatctaattatatttttgtacccattaactaccttctctttatccctccccatcctttcattcccagtctctggtaaccaccattctactctctccctccatgagatccaccttttggctcctacgtataagtgagaatatgcaatattttatttctgtgcctggcttattaaatttaacataatgacctctatttccacccaggctgttgcaaatgacaggatttcattttttatgactgaataatattccattgtgtatgtatgccacattttcttttatttttagttaagtaattaatttagagacagggtctcactctgttgcccaggctggagaacagtggtgtgatcaaatctcactgcaggcctgaaatcttgggctcaagtagtcttctttcctcagcttcccaggtagctaggagtataagcatgtgccaccatgctcagctaatttttttttttctttttttactttttgtagagatggagtcttgctatgttgcccaggttagtttcaaactcctgacctcaagcaatcttcctgccttagcctccatattttctttattaatctgttgatagacatataaggtgattctgtatcttaactattgtgaacagtgctgcaataaacatgggagttgagacatgtgtttgatatactgatgttctttcttttggatatatacccagcaatgagattgctggatcatatgaaagttctatttttagttttttaagggacctccatattgtttttcataatggctgtactactttatgttcccatcaacagtgtaccaccattcccctttttctacatcctcaccggcatttgttattttttctctgtttgataatatagccattctgtctgtggtgagataatatctcattgtggttttgatttgcctttccctaaagattagtgatacttaggattcttttttttcatgtatctgttagccatttgtctgtcttttgagaaatgtctatttggatcttttgtccatttaaaaataagatttttttttttccactaattgagatttttgagttccttatgtattctggttgttaatcttttgttgagtggttattttgcaaatattttctcccgttctttatgttgtcttttcactttgttgattattttctttgttgtgcagaagcttttagcttgatacagtcccatttgtctatttttttttgttgttgcctgtgcttttgaggtcctaccccaaaagtcattgcacagaccaatgtcctgtagtatttccccaatgttttcttctagtagttgcacagtttcaggtctgagatgtaagtctttaatccattttgagttgatttgtgtatatggtgaaagctgtgcatctagtttccttctctggcatagccaatatccagttttcccagcactatttattaaagaaactgtcctttctccattgtaggtctttggcacctttggaaataggttgcctataaatgcatggatttttatctaggttctctattctgttctattgatctatgtgaggaatagtcttttgatttggtaatttaatgcaatagaattattaatttcagtaccatatgtgtataagtctataaagggcattgcatatgacatgatttgattcttactgaaatctcactgccctctcagaaatcttaccggatggtttactctcatagctcagtgagagtaagctactaactgaggatcaaagagcttgtgacaaacctgagacccaagtcttctcacaccttcaaaatctctttccatcatacaatctactagctgctgaattcacaagctttttgtgcaagctcataaaaagcaaaatggtttggtttttgctttggccatgctaggtacaatgacatcaatttaaattagcattggtcttaccaaggggatgtagaaaggggtctcctactgacattttaatactcacttgaaagtagtgtttttccttcagatttctttatataattagtataattactgtaagtatcctttaatgttttatatgttgagttagctggaagtgccaaattaaaaactcttaatgatgaatttaaggtattaaggtaaattactccttcatttaatttaattgtaattgttaattactatttaaaataaagattaaggtttgtttctagatgccatttaacatgatattccgggctgtcagttttattttcgaagtttatttcatattttattaatgcttctacataaatgacagtctttagaaaattggtagttaagctgctttatatttttcttttcctgcccatcgtttcactgtgctcctaaattttacatctctttattctcacggtttcaaccttgaagaaggggagcaaaataaatgaaagtggctaaaaatttttctttaacccctagactctttcctgttgtgccttaattacatgcttgagtttttagaataattataataaagtaaaactaccaatttaattgtattgtaaccgtgcaggatgggaaatttctctctttgaaagataagcttttaattgaatagattaatggatcaattgttacctctgctttgctgccagagattctgtttcatcacagaagttccatgtagtactggagagctcagttgcctgaatctttttgcaaagcacttacttatgctgttgcttcaccaaccagaacaaaacaggttttttccttgagtcagctttgtaggtatagggatgagtttggcatcctatgtgatttttttcaccaccagaagctgttcagaatgttattttcttaaatacttcggaaaaaagtcttgatgtattttatgaaagcacaaaaatagttggtttctatgacagctggattgtcaatgtctgttcagcttacgtggaggaggatgtcctacttaagtagtataggtagaaatagctgtcagaaattgctgcctttgaaagcaatttgaaattatgtaaaaggaagtaatgacgaaataaagcaatttctgtttaatctggaaaagatccaaaagtaatattgtaaagagatcttgagtaatcatttttatcttcctaaaataacccttgtttactcctgcaaacaggtaagaaacttgtgccattattccttattggatgcatatagatttctcaccttgtcattcaactccttgcaatgttcaactttacttatgcatccagccttatcccaaaatagcctctttcctgtagcggcttccttattatgtagcagcctactctcctcaccactcaacagttcttatacaatctgactcaagctctccctcttcatattatattctctgagtaatttcaactcacactgaatcttactttcagtatttctattgtattggtatttattacacatcacacttaggtacttttccataagtctctagagggtggtgtgtgagtgtgtgtgtgtgtgtgtgtgtataaatgcactttctttttttttttttgaccatgtcaagtatagttctatagtataatagaattggagatcctttacatttagagaggagtctacaataggaggagtaggttaattttaatctgtggtttgaaatcaggactttcaatttttttttcagaggtaaagagcaacttaggcaagttggcatcttgtaaacagactgagtgaagatatacttaaaatgcatccataatttcatattttatttcgaaatgtgaaagagcctactaggggtgtctgtatctctagaccttatcaattcattctagagaaatctagagggagccattgaggagttctacctcctgtctatgttatagagccctttcttttttttctcctatcagatgtagagtcaattgctaaaaatgccacgtttcttgcctctattattctagcttcattaattggggagcagccattctgataacttacattttgctactaaaattttcaacttgccctaatccttcattttaagccacttcattttttcctataattaaaaatttaaatatgtggaggaaattctgtcaggtagctattacttaaaacctactaagggccaggtgcggaggctcacgcctgtaatcccagcactttgagaggccacgtcagaaggcttgagccaaggagcttgagaccagcctgagcaatatagagagagacctgtcttcacaaaaatgttttaaaaattagctgggtgtggtggcacatacctgtagtcccagctacttgggaggctgaagtgggtggatcacctgatgccgtgagttctaggctgcagtgatcggtgattgtgccgttgcactccagcctgggtgacagagtgagaccctatctcaaaaacaaatcaaaaccaaaaaaaaaaaaaaaaaaacaaaaaaagaaacgtactaaggatccagtatagccgttcttgcacttaataatcttggtacaacctctaaaactattttttgtagtttattttattttgccttagacaataggcgtgtctatgttcttcaaaatttagaaattatatatatttatgtgtgtgtgtgtgtgtgtatatatatatatatatttttttttttttttggaaatggagtcttgctctgtcctccagggtagagtgcagtggcgcaatctcggctcactgcaacctctgcctcctgggttcaagtgattctcctgcctcagcctcccgagtagctgaggttacagatgcctgtaaccttaccaccatgcctggctaatttttgtgtttttagtagagacgggatttcaccctctgccatgctggtctctaactactgacctcgtgatccacccgcctccgcctctcaaagtgctgggattacgggcgtgagccactatgcccagccgaaatgttatattttttgtatgtctttctggtctgatttttggagaaaggtgtatcctaaggatatggcttgcttttgtttcttggtaagcattttagggtatcattttgttttataacaattatttacaagtgagataagcatatattccactaagactgaagagattcatgtttgactcagtatgttctattaacattctttaaaacacgtgaatatatgtctttcttgttttcaggtgggttggtcacttctgtgcaaattaatagaaatctgcccgggtacaatgcaaagcttaatgggaccccaggatgttggaaatgattgggaagtccttggtgttcaccagtaagtatgatagatatgtaaaaacaaactgccttgagtatttatctatacacataaaaaccttcccttgatacactgaatttgcaatccaaggctactcttgtgaaattctttgaaatacagatatttttccttgagtcaattatttacatttatagagagctttaaactcagaagtttgatttagaaagcaaacatttaaggtaacatgtcaggagttattttaataatataatcatataattataaaactggttaacttgtagatttttgatgagtacttttgcattcaaaccatgaagatattttgccctttaataatagaactgatacaaaccactagttcctaaaaaaatgggaactgagaaaagttagttctgtacgtagtaatttgaaagttgatgttctgtctttaaatggtacatttatatatattcatatatatacacagtaagtttaaactacggctttcaaaaagagtaagaaagaggaaattacctttcagcacatctgcagccaaatcttgatgacaattttaccagctatgtttttgcagtttgcagcataatgacttcttaaatgagactacttccttagccacaattaattaagaaaaccttttctgaagaagaatgtgttttcaggaaaatacattatttcttgacagttaaaaaatatcttctcagctactcgggaggctgaggcaggagaatcacttgaacctgggaagcggaggttgcagtgagccgagattgcagcactgctgtccagcctgggtgacagagtgagactctattaaaaaacaaacaaacaaacaaacaaacaaaccttctgtcattaactttaaatcttttttatacgtaatgtgacttttctttaccacagaaaaggaaattgtgaatatatctggcttacaatggtatgcagtttatgaaaatttaatttatgaaaaatttttaggtgtttatattggtgatcagtatcaagtagtgctacaaatttagacaaattagagctatatgtttggccataagtgaacatatctgtgcttatacattttcccctctttgacaaatgtgttgctcttcttgttttcagtacataaagggtgtgtttggaaagagcatatttacaattaattggagttctcatcttcaatctaatctttgtaattctatgtttcagttctaaagtatacagcttttgatgaggaattactcagaatataccagtaattagcaattgtaacttttaagtgtcccttggtttggttgagaatttccaagatgtccaaagatgagccagtctataacctcagggagtgtttgggaaactcatctagtcatattcctgttcaaaccagctgttcaaattaaattacataaatatttatataggaaatttgttcactcactcacttactcattcactcactttgttcatccagtcattcatcttccattcatcaaatgttttttaagcccctcctctaggccagaaacaatgcagttgtaaagaagatagacacactgctctctccagtggagtgtattaggtcactcccggcaaaaattgattgcaaaacagatttctgttttttcaaggccttttctctccaaagacttaccagttctgaagaaaaatttcttccgtggtggtaaagtcaggaagagtgggaatggtacagggagaggtaggggcagggtgattaggaggaagactggcagagaattgaagactggcttcattcagttcctccaactgccaaatggagattatgcaacgtatcttgaatacgtacaaagctctagatgtggtcagctcagtcttttcccaacaattcgccaaacaatgctgtgcaggaatagactagagattatattttgggattaataatatagggattaaaatctcatgaatttgaactaaacattattgatatgttaagttcacttttttttttttttttttgagacagagtcttgctctattgccaggctggagtgcagtggcctgatctcggcttactgtaacctctgcctcccaggttcaagtgattctcctgcctcagtctcccgagtagctgggactacaggagtgcaccaccatacccagctaatttttgtatttttagtagagacagggcttcatcatgttggccaggatggtctcgatctattgacctcatgatccccccaccttggcctcccaaagtgctgaaattacaggtgtgagccagtgctaccggcccactttttaatatattattaatttctcttttaaaaacagtagcaatcaataatttaaatattgaaatgaattcttaatttatatacacaaactaacatctttatatctctctatattttaatatatcaacatgtctaagataaattataaatttatatcacatgtaaaaatgggtttgctctcgatgtatataagacttcatgatattttgaacatggagttgggtgaaaatagtgaatctgaatttttgaatttgaatatttattggaaaataagtagcgcttttacctttttaaatgagacacataatagttccctgttgattttttgtttgtttttttaactttattagagttgacaattagaaattgtttatatttaaggtatatagttgatttgatatatgtgtatattgtgaaatattaccacaatcaagctaattagcattccctgttagtttttataagcctgattcaggtttgtagaaagaaacaaacacacatggccaggcacggtggctcatacctataatcccagactttgggaggccgagacaggaggatcacttgagcccagaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcactatagggaattaaatacaatgagagtaataaaaaataggtgagcaaaaaaatctaaataagcaaatttctgagtatgatatttcattcttatcttgatttctgtttttaactccagattgattcttaaaatgctaacagttcataatgccagtgtaaacttgtcaatgattggactgaagaccttagatctcctcctaacttcaggtaatacatgtatatgtttttcgtgttgattcagtttaaaaaaaattgatgccattaacttaaattttttttttttttttaaagatcaggattagggtagcttgatttaaatgtcgtaaaattgcatctttttttagaccttgtgatgtgacagccacaatgtaatccaaatatcagttatttccaaaattctttctgtttccatcttttctccttatctcttttctctatacgttgcctctcaaaaaatctcattcaataccttggttttaaacattaccttatatattgtccccaaatctctgtttgtagcctgatgtttgctcccaaaatctggacccacatctcatattctccctaggttagtggtcattcatgcccttgcattattacttctttctccatatatatcttgaatatattttctataatgtatgttctggagtatgccataatagttacattttgaaaatacataacattacttcttgagtatttgctagatgccaggcttcacaagtaaaatgcttcacattcttttaaacacctaaacctgaaaacacccctcgtgatagggattttatctcagttttctaagtgagaaacactgaaatgcagagaagttgcttcggccactaagtggtagaaacagggtctgattctccatgtcaggttccttccctgagaaaactttggcctggaaaataacggacctgaaaacaaaaaatcttgaaatgatgcaacagttgtgggcattgctgtgctggacactggctattatataagtttcttagaagaaaggctgctcacagggagctaatcttgtagggctgggaggagtttccttccctgtaggggagggctttttaggttgagagaagtatgggtgcacaggcctgggagaatagcataagagaggctggacatgtgattgggaaggtttgaaatgtcctcatcagtccccatcagtcctgctaagagatgaagaccttgctggagaaagaggaagatgagagtatgagggaaaaacaagaaagtactcagcatttcaccaccgctttttatgaccatattgtatggaatgcactaacagtcttaaccatgatttaatttaacctcatacttgggaggtattttttttttttttgaggggtattcattcttcatttggcaatggacaggaagatgagggtttattaatctgaaaaatctctccacactggaatatattaaagttagcctcatacagtactaccattcctattccagtattattatttttattgacagaatagatgctgtttgtgttatgttttggattatgataggagatgtttgatatagtaaaagacaagagtatgacaagcagttagtccaagtacaaagaggtaacaaaatatttagtgaggaacagtgtttagcatatttggagtgaagacaatgtgcagagggataaggggctgatgagatacatgtactatagtcagttgtgtgatgggtcttgttttttcatactaaggagtatgagaagatcttagaagattccagcaagggatttgcaagaccacaattgtgttttagaaatataatgcaggcaataaactagttgggtagaaattggggcctgtagagcaattaagcatctgtttttgcattctagatgagaatgcaaaacacaataggaatgaaggtgccttgttcaaaaggcattttgttcagaaggaatcttcaagatgtgtaggagatatacttaaaggacttggtaacgaattgatgtgttgtttggatagagaatgagaagagaaaggatggtggaaaaagaagatgactcaggagtttctcttgggtagctattggattatggtatcattgatgaagacagggaacaggagtagaccaggtttggggtacctgtagaatattcagatgatgtctaagaggcataagaatgtatttcaggtgtttggggcaagttatctagggtagaagtactgattgggactcatgaaattgtaataaagtgaactgagaatttatctcatttataaagatctagagcttgataagtctaacatctagggcagttaagtggtttgtcaataaacaaacaaaaaaatcgtgagtctacaaaccattcacagtcttcatgtaaaaattaacacattaaatgttaaagcagatctttactcagagcatattattctcttcaaaataggtaaaatcaccttactgatattggatgaagaaagtgatattttcatgttaatttttgatgccatgcactcatttccagccaatgatgaaatccagaaacttggatgcaaagctttacatgtgctgtttgaaagaggtattttaaaatgtcaaattccttaaagtatatataagaaaaaaaggcttatactgggaaaagtagaacacaattataagaagaagaaggtttctaaaatcctactattaagaagggggagttgtctgtcaagggtgaggaatggggttaattcagcagtattgcttgttttggtggagtgaattgcattcatgggttataaatcatgccagtggagtagactttcttcagttgcataacaaggcataaggtttactttgaaaactggatgtgtgggtgttatgaaagaaaaaatacaactgaagccaagcataggttacatcgggattatgatgttgagtcatcatcagaagtcttagaaattgataaaggctctgcataaagagccaggaggtttacaaagtgtccctcaggaaaaagactaatatgcatttcatagcctggccctgagattggtaactgagattgtcatgtaattttagagttggttggagtccttgtttagtctttccattgacctgaggaggaaatgggtcacagcagtgaagtgagcatcctgcctcagggcacagagcttgtgacagtacagttcaattagcaattattttgagagccccttttgtatcattatgggagccaaccgtgctaggggtttagataagaatgatttttgcgggccctgtgtcagttatcagtttaccagtctaatttctcgcagttcccagaatgggatagatcacctaataactgagacagtttcatgatgttcttcacttgttagaaaaacttaactgatttcgcattatattatagggacactggcataaaattaaaaaaaaattaatgttgatcacttagagtgccgtattttctaacatatttctggcaccattctcaaactagataaactagaattttatacatgtttttgaggttgttgcccaataacagtgactccaaatggaacttactggcttgatcaaatgactttaattgtgaaaattaatgatctatatttttgctgtctgatggaaaatcactaagacagagtatttcaaagtctgattacttgccatttgctcaagttgacaactcttgaactgaaacatttagccgagctacccttcagcagcctaccattaatgcctccctttcaaatattgtaatatgtccaattctagttgaccatctttattagtcactgtcagttttctctagaatttcccaaatgaaattgtaaataattttgtttttctgagaatgactagcacttttacatttcaaaacattgagtaccgaacatagactgaaacaaaattattttaatctctgtagcttgctttcccattataacattcttaggaagggctgttttcacagaaatatattttttatttaaggagattacatttttttacacaactatcatgaatgttgtaatttttgaataattaaacttctgtatcatctttaggcttattcagtattttgtctttcattttttagtctcagaggagcaactaactgaatttgttgagaacaaagattatatgatattgttaagtgcgttaacaaattttaaagatgaagaggaaattgtgcttcatgtactgcattgtttacattccctagcaattccttgtaagtagcatttatatgtgatttctttttcgtatctgaaaaatcacaatatatctctttctgagtatattttaacaatatttttattatttagaaacttgtggatgctaaacccattcattcatttatccatttaattaatttacattaattgacactatactgaagttggctgtgggcttggtgctggagaaacaatagtggaaaatacaaatgtgttccttaccttttcagagcttgtagtacaatgggggacacagataagtatagaggtgattacaatggcagaagtgatggcagaagtacccagagttaggagaacaaataggaagtgaggcaatgtctcttagccaagattgaataagtagagcttcctgtgcacagaggtgtgagctgaagtgagagtgcaggcaaagtggcccaggcagtgggaatggttagtgtaaagatgctgtagcaagagagagcagactgccttcaagaagacaaaagtagctcagtaaaggtgtggggttatgagtgtgcatgcgtgcatgcgtgtgtgccactgtgcatgcgcatccccaaatatcctgtccgtttgtgtttcattgacagaggcaagggagaccttgataagaggcagtgggtgaggccagagacatggagtggagagcatgaagggcctaaaaagctgcatgaaggagtttgaattttattgtgattcttgattagcattttaatgatgctttgaaatttagccacctttttcaccaaaaaatattaatcagaagaaattaatttgatgtgtatgttaccaatgattactaataagctaaaataatggctcatattctgttttgttttgtaaatgcccattaacactttgtatttcatgtattacttgtgtgggtttctacaggatatacatatgcatttatctagtgatattttcatcctcacacatgtgaagttttgaggattcaacgagttaaaaatgtagagtagtacctggcatgtaataagtgttctaaaatcactgacaggattattacacaatatgtattttatatgtatgttgtatactatatgtaattgcatttatggtttcagatatggaaatcactgtgtcagtctgcaggtgtgagccttcagtgtaggcagagtaaaaacccaatgcccttgtgaaagaatgccttttttttggtgatgtttataaaatcacaacgttttcttatccacaggaaattaaacactagaaagtgggtgggactgaacaataatagagaaaggccatgcttttacatttctctgagtcatcattgccaacaaactgaatatatttttcattatacttttccttggctatatttattcatttatttatttattttgggctggcagtttttggaatccattgttttccacccacatctgacataactccagtaaaaatgtgttgattcataatacaaaagtcaaagaaagtggcagctaaaaattaagactcaagagtttttaaagcactgattctaactgaaaaacatttgcttttcagtctttaagtctattgttttgaatcaaagcaggtaactcctttaacagaccatttccatacattattaactttttttctatgtttaagcattataagacactttttgtgaaaacagttgattagttttggctgtgccaaaacagatactaaaatgttttgcaaacagccctttttaaaaaaaaaaaaataaaagaacagttaacatttgatgcagaaatagacatattttctccatgtaggttcgcacttcactccctttattgattcattgctttttctggtagagtctttccttcctttctgtttcacctgtgtttgtcccttagacttatattttaatattgtgcctcccctttttccttctcccatcttttcttccacctattttggagccttcaggaagctttattttgctgccttgtacactggttgctctcctggaatggaggaggaaacaggtcataactgattttaactcttctatctggtgacatattcttgattttctttcttttggttgggggaaaaaaaatgcaaaagttattatccagtgaggttgagcctcgttaagaaagagaccctccaatttattttttgaaaacttagaccaatacattacatttctagactttcattttcagtacttttcatttcgttttcagtactaaaagtactctgaatttttccttttttttgatcttaaggctttaagccaagaaacaggaaagaagtaaatttttcttaatgctaaagatgagtcctacattccattatgttatcaatgaacagcctagaattttttacagctgcttaacggaacatgatgtttaaatttggaaatgcagtcattatgctgccatctatttacaatctatataagacatctttgtatgcatatttcaaaggggaaaatggttaccttattgataattatgatctctttaaattcaggcaataatgtggaagtcctcatgagtggcaatgtcaggtgttataatattgtggtggaagctatgaaagcattccctatcagtgaaaaaattcaagaagtgagttgctgtttgctccataggcttacattaggtgagtttcttagttaatatatcatcacaatctgtatgatatacatatatataatatatatgttgcataatgatggataagtagcatattgacatactttgaatgaaaatattgtaaagtcccagaaaaaaataaattaaaaaaaagaaaatactgtaaactaccaaaccgttttgctatgtttagatggacttttaaaaggagtgtcaaaaataggtgtgtagaatgtgaaagaagtattatcttaatcttatttttatagagatagttctatagatgagtttttttattgttgaggctatatttaaaatgtaattatgtaagaattgatatatacaaaaaatatgcataacatatacaatgtaaagcataatgcaaagaactcaccatccaacttaaatatcgtatattcccagtgggggaagctaccctgggctgcttcttgcccttgctttctctatagaggttaacactatccagaattttgtgtttacaaatcttttgctttataaatatgatttactacattttcatgtttctttaagtaaattgttaacacttgcctccttttgcttcatcacaatgtaattatattgtatgttgtcttctgcaattttcaaatatcaatatgattataagaatcagaaatatttttgcatgtggttgctagtagtagtctattatttggaaataccacaatttatttttccatttttctatcaatggacatttgggttctttcttgttttatgctactactatctgtgttgttaggaaaatataaataagggttaatatttttaaaaatatttacttgccattggtaggtccttctttgtgaaatacacaatctgtcatttatcaatatttttcataggatagtctgtctttttaaaactgattcatagattctggacaataatattttgatggtaggttatatgtattgaaaataccttcccttgacttgtagcacgtcttttcaccatctttatagtggcttttgtgatatagttaaatttaataatcagttcctttgtgatttactctatgtatcttgtttaagaaatctttcctttccgagataataaatatattgtatattttattccaaatctttctcatttattaaactgttgcagtttgtttttgtaaagaacccgattctccctctttttttcagtgtggagagctagttaccatcatagcacaatttattagaggttcacctgtttcccagttgtgtggtacaccgactatatatatttatgtttctgtccctgctgttctgttgcattaatctgatttgtctgaatcaatttaacgctatttaaattaatagttctgcaagtcctgatatctgaaaagctagtaggtcaagtcactatacattcttttttaggcacagcttgccttttttcttgggcctttactattccatacttattttagaattaacttgtccagttccttggaaaacactgttgagattttgactggaattgcacaaaatatgtgatcattttaagaagaactggtgtctttacattataatttcttctatacgtgtcttgcacatctttgttagttattgctacatatcttatttttattattattgtaaatggtatttctttttacatcgtatttttgaactgtgttttcataaagaaatgcaaatgatttttttgtatattgagctaacctacctttctaaactctattaattctgacaatttgtttccaaatgctcttaaattctctacatagcaattatataatttgtaaataatgacagtctgagttcttcctttctgcttcttatattctttatttcatttccttgtctttttacatgacccagaattattaatacagtgttaaatagaatcagtgatagtagacatccttgtcttgctctttttcctgattttaaacagaatatttttaatattctcccatccaaaataatgcatcttacaaggttctacattttaaaaaaaattttaagaaattttattttatttcttctttgcttttatttttacaatgtgggctttaaaaaatcacgggtgaatatttaattttatcaaatatacttaaaatgtaagtcttttttttcttttcattttgttaatatgaagaaatacatctacaggttttctaatactaagctactttgcacttcctgataaatttaacttggtcatttattagatttttaaaaacacttataaaaaaatcttgtctgtttattttcgcatataccaggtgagttttggcagcctcttgtttttttcttttttacgctttcttttttttaaaaaaatccttctatttctttaatgattaatacatggctattttgtgttttgtatctgataactatatgtaaagttctggggagtctaaaccaactgcttctaggctgactgcccatcagtagccttgttttcttgtatgcttgtgagtttctctttgattgagtttaatatttgaacatcctgaggacttaaattaaagatgctctttcagaggtgtttgccagaagtcagagcacaggactgacgtgggagcagtttaggatcttaagatctaggcttaatatgggagactctggttgaattaccttaccttgcagagagtctgaaactcgattgttgaatgcagcgccgaaattcatgctttccctcgagactactctggcgttcaactcacagctcttgtttcagcttctttttgaactccctgtgcccctcaacacacaccttggaaacttccttgatatttttgtgaggacaacaatgcgtgtaaaagggagtggctggtgactaataaggaatgatggctaactgttggaaattgattctgatgacactttcccaaaaggataaccaggaatattttgtgcaaaattaggattattataataggcatttagtttttcatcattacaaatttttgggaaaatcattaatcatttgaaaaaactaattgacacatctccgttgtagcaactcgtattttcacttctagtatcatgattatatcccctgtataatttggaaattgattttagcattaggaaagttcctagtttcagttaaaatgaattttttgtaagttgaattctattttaaatgcacaactttagtttgttatttctttccttgataagcatttattgaatgttgttatatgactaagactgtaagatgatcatgtttaatattttcacatttctttcatagtttccaaagtgtatatatacacttatatatttgatatgtatgaatctacttatgtactgtatatataaatataataacattgtatataaatgtatataaatatatatacatgtatagaaatatacaaatgtatatacatatatttatatacaaatatacaaatgtctataaatataaatacatttatatatacaaatataaatactgtgcatatatatatgcacacagtatatatttgtatatataaatgtgtatacacacacacacacacacacacacacagtattttttgatccatgcaacaatcttgggagatgggatattgttattatttgtacatttacagatgaggtcctgtggttcaccaatctttgtgttttattcaagattatgtaagcagtaaggggtgaaatcaggctgagaacccagatttcttcatccctaaacaaagtatttcttctaaaatttggtagccatttactagtttatctctatcaggttaccctttattcattatttttcgtgagaaggttgtagttgtacaaactggctgatatctgataatgttttaatctaattcaaagttgatttcttaaatccaggtgttagagtagcacactactgtacaactctctgtttcatgttttacacagtcaagttacaacttgcacatgttacattaaaatgtgagttcgccttcatttcttgaaatgagccagaggaagaagtgattttgtttttgtgatgagggaaatgctacttgactgccaaattggtctagaagagcacattaaaggtgcttgattttatactgttaaaattaaataaaccatggcaactgtcatgtcgtatgcaacttttgtattattctgtaagattttttaaaaataaaaagagatcaaactgatcttcaggtaaagatgcttttttctcttgtttatctcttagtgaatgattattagttccatttaatgggtagataatttattgttgctgttattgtttcaaaagtagctgaataaaatgcttaactttttcttcatagttaaaattaaaacctcaagtaagtaaatatttaacgttttgccaaattatgtaatctaattatgggcttaatgcatttaaggactctgtacagtttgctatgtattttcacacaagttgtctgaacataggtctagtcttcctgctgttttctgagtcacacagtgagtcagtgacggaacagctgtaggcagtggtgtgggtataatagggaaaagagagtgatggggaccacccaagtttagacaagctggtaaaagtagaagaaaatctttttgaaaacactagtgatctttaagggctgtggagaatgtttgcttggtgggtgaatgtgaaagaggcaacagcatgggaaggtgttggtaaaggagctccatagttgcttaaactgccttttgattgtgaggccgttgatgaatatttgggctttaggttttttatgatacaggatcttttccatttctggctttgtatctcagagatcacttagttacacttatagatgaacaggagttttaattctttgttttagaaagaagcttggcaattgttagtgagttacaaataagccaaatggaaaaaggtacatatttctggaatatcacgtaaagtttttcctcataaggatttagactcttgggtgtcatattaattctcagaagaatgggtataaaaagatatggaacttcttcccagggtgggttggaggtggtgaaatatctcatttattttagtttttatttttttttctgagatcatcatagacaagatcaagtaatggtaagcatgccaatgaattttctgaacactattcctttaagtgaaagaagagggtttcagcaaaactatttaatattggatcttctaaaagacagatttaagagtttcatctttaaaagtcagaaaaattaagttattttatacaatgaatattgccgtgccatgtgtaacagacgtgacatgagagggaatcagagaacatgcagttaatacaacccaaactagtatcattatttttgctcagtcacttccattgtctaagtaagataaataaatgacagcataaaataaaatttcaaaactactcaatcatattaagctattttaattacagtaaatgttttaatgccattaaatattcatcaccatccaaaattactgatgtaaatagtgttatatgttaaaggtaatttaacttccatggatgagaattcagctaatgtttcacttaacttttaggtaatttttttaatatcctggtattaaacgaagtccatgaatttgtggtggaagctgtgcagcggtacccagagaacgcagcattacagatctcagcgctcagctgtttggccctcctcagtaagtaacttcactaaaaaggagattcttccagaggcatttgacatcaaatatgaacattgtaacaagagaatcatatgtacagatgggagttctgtcctgtgtagctcattttctagtagagaatactttcaaggaaactaacagttatgacaagtatacacatctccatgtagagttttgctttacatcattcttgatttagctttgtcattaagcagctaatcttttttaaaagaatttttacttgtggccaggcatggtggctcacgcttgtaatctcagcactttgggaggccaaggcgggtagatcacaaggtcaggagttcgagaccagcctggccaacatggtgaaacctcgtctctactaaaaatataaaaattagccaggcgtggtggcgggcgcctgtaatcccagctactcgggaggctgaggcaggagaaccgcttgaaaccagagggtagaggttgcagtgagctgagatcgtgccactgcactccagcctgggcaacaagaatgaaactcagtctcaaaaaaaaaaaaaaatttttattttaaattctggtgtacacgtgcaggatgtgcagattttttacataggtaaacgtgtgccttggtggtttgctatacctattaacccatcacctaggtattaagcccagcatggtttagctatttttcctaatgctctccctcccccagtcccatcccccaatgggccccagtatgtattgttcctctccctgtgttcatgtgttctcattgttcagctcccacttataagtgagaacatgcggtgtttggttttctcttcatgtgttagtttatttgaggataatggtttccagctccatctgtgtccctgcaaaggacatgatatcattgctttctatggctgcatggtatttcatggtgtatatgtaccacattttctttatctagtctatgactgatgggcatttgggttgattccatgtctttgctattgtgaatagtgctgtgatgaactaatcttttcaaataatccttctctagtctattaggtttttttttttttttggtaccctcttcctgattttattatttatctgtataggatggtagtattatgaggtgtgtaatatatcaaaaattatctttataattgaccaaggcttctactaaagcacacctcattctgttggtaatatttcaaaatattgaattagagttggtcaaactgttaagtaaatcatatatataatgcttttatttattttttaatttttttcaagctgagaccattttcttaaatcaagatttagaggaaaagaatgagaatcaagagaatgatgatgagggggaagaagttaaattgttttggctggaagcctgttacaaagcgttaacgtggcatagaaagaacaagcacgtgcaggttggactctcataaatattagagttactcaaaattgtgttttctaatcatttatattttgacagatttcttttttctcccctaatccaggaggctgcatgctgggcactaaataatctccttatgtaccaaaacagtttacatgagaagattggagatgaagatggccagtcagtagttttgattttatatgatagaaaatttcagttatattttaaatcaatacctacaaaatactttaaccataacttttattgttagaaatatttttgatacagccttttagttttagatgttgctgccaaatagtagtatgtatgtagcattttgatcttattacctccaggagttagaaaaggtagcatgtttgagagttattattgagagatttggaatcaagaatcatttggtaattcacaaatcatggagaaagaatctgtttcctggctgttcgttttaaaatgccatattaattcatcttgggtgatagaaattgcagagccatctgtgatcttttcttctgtggtgactagccagcaggttgtcaatatcaggaattagatttggttagagagctccctatgatgagttcccatctgatgtgacagagttgacctgtcttcttttgagagggttatttgaagctgtcatctccagataactctttcactaggagtgccattcaaacatcataagactggcactctctcccaaagatacaaactgtagcaaggagttttgtgcatatcaggtttgtttcatatccgtgagcctttgtgttttatggcaactgattatgcttgtgctatttgcaatggatatcctctgggttttaaattgtgaatgacttattttggaaacaaatagtagtattctacatctgaaatcttgacagtctatttgtttaattatctattgctgataagaggggaattaataacacagatgctacttaattaaacattttcattttgacaagaaacagtagttcttttgaaaactatgctaaattggcatcttaataatctcatgttgagcaaggcttttggagattagggtaagggagattcatgttgcagtttataaattttagttcataggatacctgtttctcaatatccataagagaactttaaaataaatatattattaaaacaaagaaaataaatttatgttgtgcatctttaaaacttatcttgcttcttgacagtttttttattgttcttttctttttaccattatcttcttttcctcactttatgtttttcctcagcatctctttacatatctgctaagcttctttatttctctctgctgcttattggtttttgaaaaagcataaaaatactaatttattagtatttaattaatttgagtcttaaaaatgaactataattaactcttgtaaggggaggtggcataaaatattgtttacatgctcttaattgttgttagagatatttgataatggtaagtgagaatttgaggtaattatttaaaagattactactaacattttcgttgaatttttgaaagtttcccagctcatagggaagtgatgctgtccatgctgatgcattcatcatcaaaggaagttttccaggcatctgctaatgcattgtcaactcttttagaacaaaatggtaagcagtgtgccatattttcaaataaagggaaacacatttttgtggtagttttaattataaaagctatatattgtgagaaacttacataatttataaagctatatattgtgaaagatctctctgtgtgtagagatatattggcatgtggattatgaacatataggtacaaggatgaagaataaaataaacatttattgtatatttttctggacttctatgtgtaaactcacacatgacatatacaaaattttacatattttgtagaaatattatactctttcataaccaaattttattttcttttttatgttgatacatgtgtattctcacattatcattttttatttttaatttttaaaattaatttttgtttttagatatggtctcactctgtcacctaggctggagtgcagtggcatgatcatggctcactacaacctcaaacttttggactcaggtgatcctcccacctcagcctcttgagtagctgggactacaggtgtgcactgccatgcctggctaattttttgcagagatggtgttttgccatgttgcccaggctggtctcgaattcctgggctcaagcaatcgatctgccttggcctcccaagtgctgggattacaggcatgagccactgtgcccagcccaaattatcatttttaaaagctatgtagtttttcattgcatgcctgtattctattttatgaaccaatttcttattaatgaagtttcagtttgtgtctagtgggatgtttctgaaacccataatacataccaatgatcactttcctcctctgttttcctttatacatggttcctattattttcttgggaaaatttcatagaaatgcaactgggcagaaagctattcaccattttaaaatctggtaaaattgtctattataaattttcacactatactttttaaaaaaatggttctttacatataattcttataagtcttatagctttgtataattaagaagagaaaatggcttgtataccttcagaaagacatgagttttaagcttatggttcaggctgctcaaatttcttcccccgtaaacaggaatactgacagaaatccttaggtgaaaactcatcataaaggcattgggacttggcagcttttgtaggatatttttatagggcgaaaaatagagaaaagcactgaaagccagagacagagaccagtgtaagcaccagcttttaatagagaacctgggtagggtgggaaaaaaaaaataaagccaccacctcatgcatgtttctttatatcattattgaagctaaataaagaggaaaatcatttcttcttcctcttcctccttttccatctcacctctctgatggcactttaataaaacgcttggagtggcaagggcactgacagacagacaggggctgctctcaaggataatgagtccgagtaacaggggaaggagaggaaatcactgttctcgaatctctcatattctactgtgcagttaaagaggtctggacagggatttcactcccaaaaatgaggactggactttgtggcttctgttgaggcaccttagagtggaggtagacttttactatgtacagacaacattgtgttggtgacgtcattcataaccacctggaaatctcctttgatatgcaaattaaacaaccaaaactttgtgaaatttcgactgcttcctattatgatgtctgaggactggttacattcagagtacaccctgatgtcttcgttcagttctctgctctttctagttccctacttctttgttcctgaccacctgtcaggtaaaatgtcctcagatccttttgtattgtctttggagttctgccttaataaagcatgaagaacttgagtagctcattcatcacctttcttgggcaatttctcattgaaagacacttgagaacctttgggtgtacagagctgggcatggcttttttagaaaaatggctacactggcaggcagaagaactgggtccttggaaccatggaggtcccaaagttgcacacatcttgtgtgacattttccattcaattaattaactaatattcattgagctcccaagtgtctagtgtctgtaggcacttgggatacattcattaagtaaaaatcccaggctcatggaatttaaactgtagtagggaagataataagactaactaaaatatgtaatatttgaggcagttaagaataaaaaatgaagcaaggaaggagaatatgatacgttagaaatcagaggagatgaagttgtgaataggcagccaggaaagaaggtgtctattgagtaagacctgcagggcgttgcatattgttttttgcctcttaaagcagttaatttcctgttaaaatggagtggatgagatcaggagtattatgtagatagctggtagatgcgatagcatgtaaaatgttctataaagtctgacgtgactttatgatgaaatttcttctcctaggtttattgcttgcaattttcaagtcacacattgggttactgtctaggatagtgattcttaaagtgtggttcctggaccagcagcatttgctggggaaacttgataaacaatgtaaattcaagggccccatacagaccttctgaatcataaaccctggagttgagacccagcaatccatgttttaacaagctctctaggtgattctgttgcacgctacagtttgagaaccactgatctagtgttgtttttgtcttttaaagcgtcgtcttggctagaagctagccactttgggaaaggttgttacaacttctgatgtgatcgagcaaagtaaccaactgtttgttgtatattaacgtgtgctattctgaatgtgtttaaaagatacgagtttttcaggttctggcagtattgtagaatgtgtatgtgatttctgtttgtttccatgttttgtcctatcttcttgagatagactacttattttatttattttttatttatttattgttattttttttattattatactttaagttctggggtacatgtgcataatgtgcaggtttgtcacatatgtatacttgtgccatcttggcgtgctgcacccatcaactcgtcagcacccatcaactcgtcatttacatcaggtataactcccgatgcaatgcctcccccatccctcctcccccctccccatgataggccctggtgtatgatgttccccttcccgagtccaagtgatctcattgttcagttcccacctatgagtgagaacatgcggtgtttggttttctgttctcgcgatagtttgctgagaatgatgatttccagctgcatccatgtccctacaaaggacacaaactcatccttttttatggctgcatagtattccatggtgtatatgtgccacattttcttaatccagtctgtcactgatggacatttgggttgattccaagtctttgctattgtgaatagtgccgcaataaacatacgtgtgtatgtgtctttatagcagcatgatttataatcctttgggtatatacccagtaatgggatggctgggtcatatacttattttaaaagcagtacttaagttaaaactttttatgtttctttttctgccactttcaaagtgttgaatcacagtgtgtaatgttggaattgatacttttatagaggcttcaagacaattgatgtttatgtggaaacttgaagacaacagatttatgtttagtgaaggaagtttattgcaaagaggaaaattggcctgttgtgatggctcatgcctgtaatcccagcactttgggaggccaaggcaggaggattgcctgagctcaggagttcaagaccaggctgggcaacatagtgagatcccctctctacaaaatattaacaaaaattagccaggcatggtggcacacttgtagttcctgctacttggaagctgagataggaggatcacttgaggccaggaagttaaggctgcagtaagctatgatcttgctactgcaccccagccttggcaacagcgagagatgctgttacaaaaagcaacaacagcaaaaaaagaggaaaattattccttaatcattattgctggaatatagttnnnnnnnnnnnnnnnnnnnnataccagttgtaaagcatatctctatgtttcctagagtttggcattactttgtgaaaataaccataattacttatattcttatattaaatgcttatattaaatgctttccattcctttgtatatgatggactatattctaaatcttatggtaaaattatgaaaatatgctttcatatccataagtgacactttaaaaaatctcagttaatttcagaaaaatcctgttatcaaaaggaatatacctgaatgttttggagttaatgcagaagcatatacattctcctgaagtggctgaaagtggctgtaaaatgctaaatcatctttttgaaggaaggtaatatagattcattaacttgtacagaatatatcatattgggccaggtagaatatcaatatttcaagcatatttctaacaatgaaaagaaaaagaaaaacgtaagacacttgaaaattgaagcattttgcaatgtaatctcgtgtcactagtaccatagacttactttatctgaacactgaaaggaatggcaagattgtggaaacatgttgaaggtctggttttgaacctgatgcttgatgttgactgtattttgaaaagtggtaattgtatagcacatagcatacagcagtttttctaatattgtgtgtgtgaaagttataaaagataaaatcaggatatagcttcctaattgttgttctttcacaacgaatatattattccttcatttgaatgaactttggcttctcttcctgctctcaatctttagttagggaaaattttaactacatctagtccaagtgcagagatgttaagattatacagctgctggttagtggcacaacagagaccagatcctttgatctatgtatggatggtggtgggatagagtgggatgaggtgggggtgaggggtggtaggtgtgggcagaacttgtggcttaaaaaaaaaaaaacctgtttaaaagacgaaaaatgaataatatgcagaaggtacctactgtagaataggctcagtgcctttttgcattttgttaagccaaaaaatatgatgtaaatttggcattgtctgagtaaatttcaaacaaaaagaggctatatagaaaactctcatgtgtagacaaaataattggcacagaagttgcagtaaaaactaattttgttcctggctttgccactaatttgagccaactgtttcatctctaaaacttcatgttcctcattggtaaagaagaatgttaataacaactttgaaagttgtaagcttagaatgtaaggattaaataaattaatttttacaaagggattaggataatgcctgctacattttaagcactcaacaaattatatctattgttatactgttattaagtgtgaatagatgaagtgcatgtagcatgaaatgtaacataactgcagacttgtaagaagtagggttacactgtttttaacatcagtctagctaatctatgtttatatatctctttaagttgtatttctcttatttaaatgttgtttttgaacactgagatgaaaagtttatcttaaatgttgattttaatggcgccgaaagtgtgcaaacctttataaatgaggcacaaaaacagtggaataaactccagtctaggattctgtagattctgggcaagcgatttgatgtttctggctgcatgctcttaagtaaaatgtgtacagttgcagtcctggagattccacattggctctggcaatgtgtctgcccctagagaactcatgttagttgagagactgatatgtaaacaggttattataatacagtctcagaatgcagtaacagtagtgtgtaaaatacacaatggtaagagtagagtggacccagctggggttacctaaggagggcaggctccaacagagggatgtgtttaaactgggactttaagttggaaaagaaggagtgtatctcagtgtccacagaaccatgcaaagtgagaacatggttctgatatgcacaagtttcagttagcaagtaaagcaaggattgactgtattaaagttcatagtacctaccgcattctagtcaagtgacatttgctcatatgtaaaagaaagaatagcttaaataccttagagaaaacaagactgtaaaacaaattaaaagtaattaaggatactatataagaagtccagtgatgttaatctggaagaggaaggttcatgtgctgtaaagaggccttatcttggggtcagacaagtttgggtaccagccttgtctctgtcactttctagtgacaaaacctgaatatttaacctctatctgcctaagttcttcatgtagaaaatggggataataacacctacctcctgggattgttgtcattgacccaccctaggtcagaaggatgttgttagttttatgaaatgaaataattcccaggttactatgaattctatcttatgagttcaaagtttagacaattaaaattatgtatgcttatactgctgatttcaaatgcattttcatatagtctttcctgataaaatatattggttctgtcctcctgtacttacttcaatttggtgtttataccattgaatcagatcggtcttccaataaacatgccaattttatatccccagcaacacttccctggatacaatggcagcagtgctccccaaaataataacagttatgaaaagtcatgagacatcattaccagtgcagctggaggcgcttcgagctattttacattttatagtgccaggtaagttacatagttgattgtgagaagagataacaatttaaagggatttttgacttttcatgaaatagcaattttctaggcaaatattaaaagactagtttctgttgactaaatgtaaatctttctgttacaccaaaaacaaaaataggggttaaatatgatgcagaattggcatttagattaatttttataaaaaatatgaaattcagtaatttatttattttaaataactacaatgtaagatgtggagattttatttttaaggagagtgttcatctctgataattgttttctatttttgttgctgtgacctgagttcaagctttttttcacttgtttgaattgtactattagctaattttcatacctattctcttccttcatttccatccttttcttactctgtgattgaattaatctttctccaatatggcgtgtactcatttacctcaatggcttccaccctccacccacctttaattcctacttacatctgttatcaccttatttgttctcaaaagcccctttaaaatacccatgtctctattcattcagcacatttattaggtgcttcttatggtctaagcactgtgatgctgttaagctttgaaagatgaattggaaaaaaagcacaactgtactattataggagcttagaggtagatggacgtgtaaatagttaattaacaggcagtgtgagaggggccatgatagatgcatgtataaaaggctttgagaatattgattgaggcacaaataatttcttcagaggagtaggacagagattataatatttgaggtggaagggtaaatagagctggcctggcagaaagacgaaggaggacatttcaagcacaagaacatgcacatggtcaggggtgagtgaggcatagaggatgaggagagtagtgcatggggatgagtgtggaaggacaggctgaggcccaaagaaaaggggcttgaatgcagtgttgaaaaatctatgccttgtaacaatggaagttaatccaagtttatgaaaagtgtttacagattgtagtgtcacaccgaattttgcaactaaagacaatagcattgtggtgtagaggatgatagacagggagagagactatataaaaggagattgggttggaggtctgtggtagtcaagtgagacccggtgaaggaaccctgcagtggaaacacagatgagagggcagattggacagatggttgggagatctgtttgatgtgacatcgtgatccctaagtatgagggatgatgctttgttctgtgaagttcccaatcttttgcagtcatttttgctttgttcttttaaaatgaaatcttcctaaatctatcattttctctagttatatagacattttatgtttctgcgtataagagtattattcgatatacaagttttttaaggacagagctttcttcagtcatgtttttccagtcctctggtagctattcagtgttttaaaaattgagtcatggtgtcctattcatagtttcagcttaattttgagacataatttaacagatgtaattttgcttgcaaatattattgcgggttttattgaattttatttttagattgtaattaaaaacaataaaaatgccttttgattatccttaaagttgacagccttattcttttgagagaggttttgagttttaaagataaccagaggacactcaaaaaccgtatctgttaatgaaataatattcttttagtccaaaagtaagtttggaatacagtgtttcttttcttttattgttcttaaactgaccctgaagcaaaattgttagtcagcaatcaatcagatgtattatgggtgcccttgaaaataatcacttgaggactgtacttcatgtaaaaaaatacattttataaacatatcagtatgtaagtacattcttctggtaggtaaaggcttaatcatttactctatgctaacatattatactaccacattacaccatactgtattgtaccctaccatcatgtaccatgccgtgcagtaccatatcattctaggtatcaacaaggaactatggtagcaatactccggtagtttctaggttgaatatgattctgttttgaacatgctaagttgaggttcttataagatacctaggtgtacatgtattcatttattaactagattatattcaggttttttagtggcaaagatgtacgttatggcaaatgtgtataatttagtgtccaattaaggatagcatattgcatctagtgtatgtatcttaagtttcttccaatttattactgtacattttctcttttactttgtaacaacttgttgaagacgttgaactggttgctttaagaaaataataataaagacccagttacttcaataaaatatcatttgacttgttgtttcttgagttactgctagttttagaggaaataatgtgaagttctttaagaagggatataggcgaatagggaagtatacagaggagagtgattagggagataaaagcacatcaaaaagagcgataaaaggaactgagattgttttatttgaagaagagatgactcaaggggatatgaaactctgttaaaatctactcacttacaaccagtaacagtaataatactaaacgaacatggagaacttaaaaagtattagtcattgtttgaagtgttttaagtatattaactctttcaattctcacaatactccatgaggcagatattattattattattattattttggtattgtatggacaacaaaactgaggcatagaattgtagaggtttttaaggtcaggcctgatataacagcaccagattttcagcgtatgcaggctgactccagagtaggcattttaaaataaatgtttgtgcaacaaatttgtcctgaacaactgttgtatttaaagcactatgtctagaatccttaaggtctggggagatgatgaggttatggacactgctctcaaaaaaatgtaccatctgcacaacttaaaggactgttatgtagaaaggagattatatccatttgaatagtaggacctcaagtgatagaacaaagactggagaagaaatttacaggaatgttcatttggtcttaatataaggaagatgtttagtaagacccattacatgtagcatgatgtttttactactcaaacaggccagttttagtgatcacattttcttaaggcataataggcagcctcagaagttagtgtggtcttggtcactggaaatgatacacagagagtttaagggacttgccccagaccacacgactgcagtgaatgtcagaacctctttgaatacattttaaaataaggactgaaagttggagtagggtggttatcaaggctgccttctttaccatagtattcccagcatttaacaaaatccttggcatgtaattggaattcaaattcttcttaaataaatgaaaaacctgctgtagccagcttatagtttgtattaatgtagattattaaagtggaagattttaaatgattgtttgttaacaattatgtctataatcttaggtttggaaaacattattcattcataatatttttacttacatgttatattacatttttgacttgtagtgtttttagcatagttcaactatagtgtagcttaataaggaatatgattttttaaaaataacaatgctattctatagcctttacaggacttctaaaaaacgacatgttctctaccactttaatactgaaactcaaatcttattttttgccacgattattccagctactcttttttgactacttttcatttctgacctttttatgttgtagtccaaataactttgaacttttctcaagttgtccattgttgcatacaaatcttccagcatcttaaagcacagcctactcacacaaaaaagtgattgcttgccgcagaaaattgcttcaccatcataattttttgctacttcaaattcagtaagcattcttacacattatatttattttatattcagtgatgaactatctttatagattccttaaaatttcgggttatttctttgataaggaaatatgtagtagaaaaaagtacaacacatatattgtaagattaattatgacaatttctagaaagtaacagtctgttcaactcaaatgtttataagaaaagtctttctttatttatttatctgtgcatttaggcatgccagaagaatccagagaggatgcagaatctcatcgtaagctaaatatggttaaaaaacagtgtttcaagaatgatattcacaaactggtcctagcagctttgaacagggtatgttgaatatgagttttctgtctttacactgttaactaaagtattaaatttggagaactagggggctttttcagtcgaagttttctattctccatttactatgatagcaggaagtcatgtggttagagacataagatgtgggaagtgaaaagatacgtactaagctaagtccagctaagtgtattatcaattgcaaatgtaggcaagattcttttgattgccagtaatataaatccactctagtttgctcaaccaaaaagagaaccaaagagccagatatgcagctagaccttatgagtcatgctgggtgctatggctgctgttttctctgtctgtcctctccggctacttatctttcttttctggtctcatggtatatgatttagcccatgaagacataccagggttaaaagtaaagtcttcgctgggcacggtggctcaggtctgtaatgctagcactatggcgaggctgaggcgggtggatcacgaggtcaggagttcgagacctacctggccaacatggtgaaaccctgtctctactaaaaatacagaaattaactgggcatggtgatgcacgcctgtaatcccagctactcgggaggctgaagcaggagaatcgcttgaacccaggaggcagaggttgctgtgagctgagatggtgccactgcactccagcttgggcgacagagtgagactttgtctcaaaaccaaaacaaaaacagaaacaaaaacaaacaaacaaaaacagtaaagtcttctttgattccctgtgctccttttcattgctctcctaagagataacctctgaaatgatttggtatacattgtttccatttattagcatttatatatctatgttcctacgttataattaaagtatcaataaatcatactgaatatgaaaaagagaaaaagggaattaaatttaaattgtgtaatgcaaaaagttttggtggaattaagttttggaaattttgcataaaatgcattggttctttattaaagatgttaagaataaagacatgattagtgtgaacgtttttataaaaggaggagccaatttaaagtaattaatggaaatgattccatgtgtttgatatactttgataaatgtcataaattaattaaagtagcttccaaagagatctcccttaaaaattcattttaaagtgaactttataatgtcactcactgcctataatatgtttgagtcatttatactcaaactttaatacagtccttgagtatggcaagaatttatgttgtaatgggttaaatttaacttgagaaatatttgttgaaaataagtatatggaaggaagcggttaggcatttagaagataaataaaaatgctttgtacccttctctcctgaatctcataatctggttattgatgtctgttgtgaaaccttggttcttttctgtaaacaagagacacacagcagaggagatgcagcatcgagtaatttattgcaaaagaaagaatattttgcaggttaagtgaggaatagacacttaccctgacagaattcagggcgggcttgctagtaaggaggagactgcatagactggcactaggaagactccatttgtgggagtcatacatgacttttcataagcaggtgggaagacgtgttactagtaagcatattctaggttgtcctctgggtgcacatgtgcagtagctgtacatgtttgttcatatatcccatgtctcataactctctgaaatctccacccagcggtgtgtgttttactattataatgagcaaagggtcagtctgaggacaggaaaatcaaaatgtgcatgctccctacaggggcaattccctactggagatagctttgcttgaatgagctggactacaatgcgaatgctgaaacttattatgttgacagtaagattgccacagttgccgcgtcctgaagacatggttacttccttttaatacctatcctgcctcattgttagaggaataacaactgtgcataaaatcagttgttctacacgagcacttaggagggataccagcattgtgaacatagtctaagtacatagaggagggaacagttaattttattcatggtgagtgttggtgaaaagtggaagaggtaccaaaaaagccatatatataactggttccagttagccaatattctctaaagttattagagaagcctaagtgagatgtaacctcagcagtcgggagccaagagagcaggtaagtgctgtgatgtggagaaaatcgctttgttccatctgagaagaaatggttgaacactgcttttccccccacgccagtacttcagtaatgacgcacagcctttcactcagcactgattatcgttagaggtggcgagttaaggtcatggagaaacacaagtaacaatattttatttcaaagacctctccagtgtaattcccctaatccttcaccatggttgagaaaaatggctctaagagatgagagtgattactgtagctccaaaattctgtgattgcatgtcttactctgaatagtaattacaaagcatcagaggttttaggtccaaatattgcagacacgataaaatgaattacattttaatacatctaaacttggagagcagagttccaaataaggtagaacttgagattcaactctgatttataaagcagactaagaagagtatttatgaaagtgaatccatgtttggatacataaaaatgcaataaaattcaagctgaagttaaaatctctgtctagaacagcgatgttccatttatgcctgatccttttagcttttccacagatgaagactttgtcacctgttccagagagatatatttgtccattattgtttccagagagcaaagcagaaaatagactctacacattttggctgcatctgtgttttatatgtggtgacattcctgtgttcttcagtgaggaaatccagtaaagtaaaacaaatcttcagatgaaatgggcacaaatcagagaacttgtgagcttcacaaaaaccttgaagcaaaatatactcagcttaaatattgaatatatttatttcagtagtcaaaaaaagagcttatctgcaaaagcaacaccaataacaataacaacaaattgcatataagtaaaatttataaaaggtttacaggatggatatacagaaaactacgaagcttaggggtagagaggagtagctgaatgtatgagaagatacatcttctattttgataaaaggactaaatttttaaaaatgaaaattgatctatgtttatggacccttagtaaaaataacaatagtattttctggaactaagtaagctagtgtaaaatttgcatgaaaaaattaatacatatgagcaatcaggagaattttaaacaagagtgttaattcatatggcctaactccaaaagataatcaaatgtattatacaattttagtaactataatggtgtgatactggcactagaggagacagatcagtgccacataagggtggctcaggaaatagacttaaataaaaatttgtaatgttatgatattcctcgactgctgggaggaaaatagattactcagttacttgtgttggaacaactaactcttcagccatttgggaaaagcaaaggaagctgaatatcttactccttttgccaaaacaaattacagatggatgagattatggtctaaatgaagttggtatatgtacacattaaaagtttcaactataattgttattaacgtaaatgataacgaaatagcttgttggagagaaatttggtaatatttatcaaaattaaaatgccatattttctgatcagcaatttcattctaagaatttttaatgtagatatacttgctcatgtacagaaatattattagacatgaatgttcactgtggcatgatttgtaattaaaaatgtggcaacaaactaaaagcttacatgataatcattcatgctgttcgccaaatatttttagttctccaccttccggtgattctggcataggatttagtagttaggttgaagcatgtgactaagtttggtcagggagttgtaaatggagggagcactgtctcaggtatgttgacctgcagtgtttaagatagtagttgctctgtcagtggaggtccctgagggactacaacaagcagagtcccctcctgacctgcaacacatatgtagcatgagcaataatggagcttattatttttgcaccccataaaattttgagaattgttactgcagcttaatttaatctttcctgacaatgcagtactcatcaatagagactaatcagataaattataccatttccaaattatatcatcctacataaatattaaaaaacaatgaggtgagattcctaatgtgctgctttggaaaaatcttcaattttctatgtgtatgaatgtattccccaggtattcgttttttccttcctgtgtgttgacaccttatgcacacttttggctgaaattaatatatttccactgctttatgtcctctccctcgcttttatcacccaattgtagcaaattatatgttcgcttttatagctttagctatgtaaaattttctaatagctaagtttgtggtttctggaattaagacatctgaatttaagtctgacaccactacctacagactctgcaccctggacaagtacttaatgtcttggttttattatgtataaaatggagataataactgatttttcagttagagttgttgaagattttataagataattcatgcggaagtgtcagtataatgattggcacatagtacgcactcaataaatgttaatgttattgctattagatttaaaagtatgttttgactcctggctatataagatgagagtatttgcacttctgatatctcctgttttcccacctactttttttcaataaactaactccacattggcagagtagataatatttatattcagctttctaattatgctttctaagtttgtgtttaccttattcctacagttatttggaagcagtcttcatctcaagtccttttgttattgtttttccattcatcttttagttgtctgaatttctttagaaaagtttaattccttgaatatctaatgtttatatttcattgttgctgtttttgcctttataaattttgcactcttaaaaaaagttatgttggttgtaaaatattgttttttttttttttccctgaagtgtttgtaggcatttcactgtgttctagtactgaatgttttagtggagaagtctgagaccagcttcatttgtttcttactgttaagtgcttggattctttgcctggcgctgaaagaattttttctcttgaaatctatccactttagtaggatatatctcaatgttagtcctgggatatggtattctcattctagctatacattcaactttttttcctgggaagttttattgaattgcatctttatatacatgtatattacatatacatatacatatacatggtaaagatattaaggataaagatagatgctttataaatatcaattcgatataattttggcgtgaaaataagcctgtggtgcattttgagtttggaagtagaactggatatacttacttattattatttttaatacaaaagtggagacagggtctcactatgttgcccaggctggtctcaaactccttgactcaagcaatcctgcctcgacctcccaaagtgctgagattacaagtgtgagccaccgtgaccagcctaaatatctgtatttttctctttcattattttagctctcttctttgaggctatcagtcatatgatgttggatctcttttgccttaatcttttaatttttcaaagactaatccagcgacactatcaccatgccacttacttgtagacaagggagatgattccaaacatttagcttatttatcaaaatcagagatgggatttataagaaaaaaaggataaagggagaaaacaaaacacaaattatctgggaacgtgagtctgttttcctttctttggctaatctacttacctagtagctaggaaagaggccagcgtgagtatttttccattgagctggcaagctcactcattagagaaaccatttcaatatttatggattctctgaaaaaaacttggagagtagtaaagcataggtggtaggatgctgccatccttctgttggcatctccagagtttcacttgaaaaacacctcctaagtagacactagtaaattgattttaatccctatttgagcaccagtgcaatacgttactattgcaagatggagcattagataactgaaggaaattcttttgtgggtttgtaaatatcacgatagtcatacctacataatacatatatgtatatataaatattaatttttaaacatttacttagctattaaaaatcaaatgctcatatttaaaattatgagtttatactctgaattctctttttgcatagacaaatcagagattatctgttacaagtcattagtcatcattgacctggactgaaatggttagagcctaggggagttccaggtaaaaggaccagtaaatgagtagaaactcgttagatgtagagctattaaggacaaagggaggtgctttataaatatcaatttgatataattttaacataaaaagaagcttatgatgcactttgagcttgggagcagaagtggatatgtaattgtgtaataaaatggaaatgcactctccttgtttgaaaattattaaggattttacaagggtgatgacagagcattgaagcaagtgctctctgagcatgaagccgtatatgattgtacaaatacacacctgtgaagctggccttgcctgtcaaacaggaatgttggtcctattaatcgaacagaaagttcagaatgacaatctgactttgttttgtagaagatactaagttttggccttgaatatttgagttaagatactggtatcaagcaaaaataaatttgggcttagaactttagagagtttaaacttgtgctttgacttgtgtgctcacatgtctctgtgtcacaatttttttcatccgtacatcaggacaacaatagtgtgtctacatcacaaaggttttgggaggattaagaaggtgaatacatatgaagtacttaaaagaatgtctggcacagagcgagtgctacataggttttggcattgttattgtggtcattgctattgttattacgacctgaagtcatcttagtgtatgaaatcccacatatgaatagaaaatagaaagaactttgggcaaggtttggaggtgaaagaagagatcgtaaagaagatgggtaaaggaatggttttaaagattgagaataattaggggggtactgtgtcatggaaattaaggggtgaaaagcaccaattaagttgttattagacttttttctttggtttatgttcagaatggctaggaaagaagtctgattataggaaattaaagggtaaggcgaatgtggaggtagtgggagtcgacttttctattgataagtttagaaataaagaaaaagtggtaacttgaggaaagagaggaccaattaagggaaagtctctcattaactctgaagtttttcatctctgaggacagcgcttagccccaggcctgacctgtgatgattgctctctccaggtctgttccatggacagagccatctcatctcctccccatcacagcctgcattaggagaattgttttaaggatgagggagctgagacacagcaaaccagccttccaatttcacttcgcacgactctgaatttctttatatttcttgaatagaagtttcactttttacttaccacttcttagtagtcattgtctgagtaattgttacttcattcatttaatggttctcagatttatttaatggttctcagattcacagaatttaaacccaaatttaattggcctccaagctgatgtgcttatggaaacagtgacaggaaacaaaaacgtcacgggagacaatgtcttattaagatgatacatgaaatgatgtccaagctgagcaattaaagtgtgaagtggaaggacacagggtgagaaactgatacttctcagcctctgtaaagaagataatgagtaaagataattgagaggcattaggggagtagactgagaaagggatagaaatctgttcactgagagtacagaaatgaggaagcttggaaggcagaagatttcggtcaaagacatccggcttgaagctatttcagctctttggattatctgtggtggaggccatcacgtctttggagtggaggtaccatgaaacgagtgtctgcaaaacatcatctaaatgaaagcaaaattcctgggaaggatggcattataatttttgaaagaaaagctatgagttgagcattcacaccaaggtagatgtttggagcgtattgcttgtgtgtgaaaaggcagagatgaccagaataagagttagatgtatgttgcattttcttcttggttgatgagtaggatggtctggacaaagaagtgacctgtattaaaatacctttataatgtcaaagcatctggaggaaattcagattaaagaggttggatgatgttgtaattaagatcctgggcttttaaggtggaaacatttatattcaagtcccaggcccagtgcgtattagttctgtgacttgagctcttacttctgcatcttcaaagtttggcaaacctattacatgaagctgtcgaggagataaatgaaataaggcatgcaaagaacttgcagtgaagagtaattatcaatattttctttgttgagaggcagcattgcgttttactggtcattacattttactaactattaagttagtgtggactttgagaatagttctcaaccattctaaccctcagtgaattcttcttctaatgggaatgatatcagtatggatttcatgagattatgaaaagaaaatgcctacaaagtatttattacaatgcctggcacagagcaagctctcattaattgtaaaaatgctaactcttattcttcataatgcataaacataattaatattatagaaaacaaaatcaaggatactaatttgtgtttggattaattgatttatatttcatcagtctataactggtcttaactaaggtaagtattaagatctcatttttaagagcaagtattcttttgatttcagttcattggaaatcctgggattcagaaatgtggattaaaagtaatttcttttattgcacattttactgatgcattaggggtgttatccctggaaggtgctgtggattcagtgcttcacacactgcagatgtatccagatgaccaaggtcagtacaatttgaattctggatttagaatagatttttgtaggccattagctggcgactggatgtctgtaaatatttttcttcagttttgagatttaaaacaattcttttttttttttcttctagaaattcagtgtctgggtttaagtcttataggatgcttgattacaaagaagaatttatgcataggaactggacatctgctggcaaaaattctggcttccagcttataccgatttaaggatgttgctgaagtacagactgaagtatgtgcattatcttggaaagaacttgggaacttgtgcaaatttcacttttggagcagttcgtgtaattcccactttgcatgaatggggtattctagttaatggaaaaccatttatcattttgtagttattttaattatacaagcaaagaaaattggattgaatctctaaagatccagtgtttcattattaaatctctaaagtcagcatgtttattcaccatttatcttgcccataaaagttcagagactgtgcttagaaatctcagctagagctgaatttattcacttagattttagataaatagaatttataaatattccaaagtttgtcactctctggttttattgtaggttgcttacctctaataatttgacttgttaatttttttccttgcagtgaaaaaaatgtttttaacatttttcatcaagcaaaatttaaaacatgatatataataactatctttataaggaattcaagatattggcctagagtgagttcaggggagattaagaaataattttttttttaattgtagcaaaacaaatagcttttcttcaagagtttctgtcttagttgtggagtttgcaactttcataaactacactaaggaatttttttttttttttttttttttttggagacaggatctcactctgtcacccaggctggagtgcagtggcagatttcagctcactacaacctctgcctcctgagctcaagtgattcttgtgcttcagcctcctgagtagcttggactacaggcatgcactcccattcctggctaacttttgtattttttgtagagatggggtttcaccatatttcccaggctggtctcaaactccccagtctcaagcaatctgtcctgctcagcctcccaaagtgctgggattataggtgtgagccaaggtgcctagccgactcaggaaatattttttgtaactggcagcattgaccaggaataaaaatacttggtctctaatctttgcacagacaccatcagtaaatgagagaatgtgtataaagtgttttaaaaaattatgaagttaagaacatacaaaattcttacattaataacaacaatgtgttttataactgcttttcataatgtgcctcaggataggctgattagagcaagataggattgattaaaagtaatcttaaggaaaggaaaggattttatgcgggtatggaactctcagtcactctggattaattcatctaggcattaattttagaatctctacagtagaggttatgaactaaatctgtcctgccaacatattttatttgtccagttcagtgttttattttattttttgagacagggtctcactctgttgcccaggctgtagtgcagtggtacaatctcagtgcacagcgccatccgcctcctgggttcaagcaattctcctgcctcagcctctctagtagctaggactacaagtatgcaccaacatgctcggctgatgcttgtatttttagctgagaggggttttgccgtgctgaccaggctggtctcaaactcctgacctcaagtggttcgcccacctcggcctcccaaagtgttgggattacaggcatgagccactgcacccagccttcagttcagtgtttaaaagtttttaattcgattgatgtactttctgcacatttgcatgacctgctctgctgcagcattcactagttttcagggacctctggctctagaggcaggtagaccacctgtccctcagacatacataaattaaggctactttgcttatcaaatattagtatttgtagaaactcagtatcataagagtttgaagtaataattttaatatttagatgatttaacttaatttaaattttttttgagatggggtctctgtggcccaggctagagtgcagtggcacaatctcggttcactgcaacctctgcctcctgggcccaccctcctgggtgggctcaagtgatccatctcattctcctgagtagctgggactacaggtgcacgcacggctaatttttaaatatttttcatagagacaagattttgccatgttgtgcaggctggtctcaaattcctgggctcaagcaatcccagagcgctgggattataggtgttagccacggtgcctggccaattttattaatatgtaattttagaggtaataaaatgttaaaaagttaagatgatctttgggtttacccaagctaaataatactaaagtcaaatcccagtctttcattaaaacatcacatgggtgaagaggacagactctggggatgtgcttaaggtggttctaaaaaagtaatggtgttctttataaataacttattattataatgtaatcctcagagtgccctcagtgcttctctattacactcaacataaatgaaacctaagagtccacgctagcctttttgaggtaaacatttcagaagacagcacagaaagttgggggatatgctaggctctctagagaacctactattcatattataataaaaatttttactctgttttcctatttggatgtgtagctctgctgatccaactgttttaatgctgtttaatatctgggtttcatcctacaactatggctttagacaagcatctttgaaaaccaaatttgaggggattagttcttttttctgctttgctactggatggttaactagcattttattctttgtacctgctatatttcttagtcatgagagagagagggagtatttatttacaggataaatactttcaagcaccaacccagtatatctatagttaaatgaacatcctaggtattgtttcatatacaaactctctgctttatactgtttattctttttgcctataattgcttagtttattatttttttcttatacttttagggatttcagacaatcttagcaatcctcaaattgtcagcatctttttctaagctgctggtgcatcattcgtttgacttagtaatattccatcaaatgtcttccagtatcatggaacaaaaggatcaacaggtacagtgttttccacttgcatcctaaatgttatgtatttatctgactctaattctcatttccactctttttagtttctaaacctctgttgcaagtgttttgcaaaagtagctatggatgatgacttaaaaaatatgatgctagagagagcgtgtgatcagaataacagcatcatggttgaatgcttgcttctattaggagcagatgccaatcaagcaaaggagggaacttctttaatttgtcaggtaaatattaaaggcctcacttgtgtctttgctcattattcttatcaaatgtaagagccctgccgctgtgtatctcttacttacatcatattattcttcactacggaaatttaccagtttattgtaattgcttgtatcttgtagtagggatttagatttatagaattccagaagtaatagggtcctttaggtgttatccagtctaatctttcatttcatctgttggcttatcttgttaagttgataaataacttttcaaatgtgtcccttagtaggcatctctacaacttgttctccagatacactccacataacacatagttctaatattttgataattttttaaccatttttttccatggttttagtttctttgcctacaaagttctcctctgagggctaccacacatgactatgcaggctgtgaatgtcacacttttgtgggtgccattcacactgacatgagttgctattggccaaagttgtgtagtagtgtggtctttctttccttctctcttccctcctgaaccatgcaaacatatatctgtctgattgttttgctcttccttcaaaatataattcaaattgcctttctttaataaagccctccccatacctccaaacaaaattaagatttacttcttctgtcagttcatgaaaatatatacatatctcttgtgtacttggtgagttgtgtgaaaataaccatgtatagtgttcgtctttgtatgattcagaatatctagctcattgctttacatatagtgtatattctaataaatactaagttcattgcttgtatttcagatttgtattatttgtataagtgttagagtttatactagcattcaggtagcactatgtctattttctagaaatttaacatttctaacaaatattaaatttcagtatttaataatcagtattattatcagtaaataatcagtaaagtactacgtttgccaataatttactttttaagctttactgtatttaatatcccacttgcctatgaattgaagttaatttgttgactgttaagattaagttaatactaattagtaatcaacataaaaagaaacagaacgtggaacccattttcatgcaccattatgtttatgcattaaaatcacataaacaatctaattatttaaatttagtcaaatttcttttaagcaagcaaaaattaaaatagtagttctactttattaaagataattaaatttttccatcaataatttaatacatttttatggtgcatcttttgcatgcagattattgcattaatgttaattgaaaataccaaagaactaaaaagaaacttccccttctaagtccacattaaggaaacaacatacctaaaagctcctgatacaactttactgcattccccacaggaaatcatttctgctcttctttccatttatccaaatcttcctatacaacaggatttttactttatttctctttccatattcttttggccttcatatgcttatttttatcttttcttttcaaaacaaaatcttaaatccaaggattatgtatcagacttaaagaatttatcccagttgtcagaagttatttatacctagcaaataataactgctgattaaatcttgtggatgaatttattgtatgtaccttatttgtgccagagcaaaataaggtaatgaagactattcatttaacaagaggttgcatgtagaaggagtatctagtgcacgggtggagttgtgttaggctttctgcagaaaatttaataatggaatgtacatgactggtggagaataatatgaaaggttaatactggatatgcaaatgcatggataaaaacctcaaggtaaaactcatcaaatcacagtggaaaaagtatagtgaagtctgaatgaaaataataagaggctgggcatggtggctcacatctgtaatcccaacactttgggatgttgaggtgggaggatcacttgagccaggagttagagaccagcttgggaaacatagtgagactccatttctacaaaacaaaacaacaagcaaaaacccatgtatgatggcacacacatgtagtcctagcttcaggcagagtggctcatgcctgtaatcccagtgctttgggaagtcaaggtgggaggatcatttgagcccaggagtttaagaccagcctgggcaacatagttacactcccatgtctacaaaaagtcaaaaaattatctgggtatggtggtacctgcctattgtcccagctacttgggagtctgaggtgggaggatgacttgagcctgggaggttgaggttacagttagctgagattgcaccactgcactccagcctaggcaacagagtcagaccctgtctcaacataacataacgtaatataacataacataacataacataacataacataacatagcataacataagaatgctgaggcgggaggatcacttgagcctaggaggtcaaggctgcagtgagctatgattgcactgcggtactccaaccttgatgacaaaagcaaccaactaaccaacaaacaaaaaaacaataaaaccaaacacctccatcatatgcattaccagctaggcactgctccaaatactttacacaatttaatcctaacgacaacctatgaataggtccagtagattctaatgttattcccattgtacaagtgagaagttgaggcactgagggattaaataacttgcctaagaacaagctcctggtaaatagtgcaaaatctgcctccacagtgcctgctttgatttcttggctacacagcagattcatggtagtggtggtagtggtgttcatttactctaaaataacagtttaaataatttgattttgataatgtgctgcatttattataaattagatgatcagagaaagattgcagggataagaaattatgcttttgataatctttagttattatattctgaattttcttcattatttaaatgtgaaaataaatatctgtaagcagtagtattttcctgtcatgaagttgaaattactttcataaatatgtgtgaatattctaaagagaatgactctgtaggatttaaagaaattaattcttatttttgctgacatttatttcttttctcagattccctttcttatatctctctctcttcatggcacccatatgcctaaagtcagcttggatagtttggatcctccaaggaaaattccttccacaaacatgtgcagagcacagtgctagataattaatagagaatatataaggggtttcctgtttcaagaagtttataggtctgtatgtgttgggacattgacaagagaataaaacataaatcaccttagtacaaagtaaggagtgagtggcttatcctagagaaaaaaagttactgggctacaggagaaggcatttgtgagtttttcccttccctcccctccccaccctccttccttctttccttccttccttccttctttccttccttccttccttccttccttccttccttccttccttccttccttccttccttccttccctccctccctccctccctccttccttccctccttcatctttcacctcccttccttttaattttgctgtgagcccttaaagaggattttagtaatttactacttaaattaaatatacgtcctaggtgttgtgctaggcttcaggaatacaagttgaattgcagtaatgtacaggcctttgcattctagcaagaaaacagatgggtgtgtacgtttgtttcctcagtgctacattaaatgaaatggatgggagccaggaggggaaatagtgtgtttggcctgagaggttagtagcaaggacttctccacaagaaattttgaacccaattcttcaagaatgaacacctttttgctgggtgaagagtagaggaaggcatttggggtaatagaaatagcacaaaagataatgaggtttgaaaaattacatgctgtgtttggaagaatgtccggagcagtggcattttaggtttttaaagaggacagtgacttgatcagagctctgtagtgctttgagtatgggttgaaggtgagtgtacttggagactggtgggcatttaattggtgccttccaaccacatgaatgaatgtccccttaaatcccttggaagcactttgatcctagaaaattcaagaattgtccccaacatctttttcctctgagttggtaccctggatctttgggtcttcttttctttccttttttaatgtttaattttgggtaatgaaagtcgcacaggttttgaagccagcagatttggcttcaaatccaagtttcagttgcttgccagctttacgggacaaattatatatcttttctaaatactcatctattaggtgggagaaataattgctatggcataagatttttttttttaaagattagaaatcacatgtgtacagaatttagcacagtaactgatggatattatttctattacctgttatttttgtcttctagttgatagctccttgctaacgtctagctcctttccaaagctcttcctgagtagggccagtgtgtagtgctgcaggttgctaaggcttctcctggcttgctgagttgttctagtttttgtagcaccttgcgtgctaacccaccccgagcacatgctctgaaaacataacattcagaggaaggttgaggactgagagacaaggtatatctttgaggaaattcagatgcttgtactgaggagatcaggaaaaccagacacgagtaatgattgtcgtttgtgtgtggcattaataaattttacaatagctaagtcctcatttagttattctatgtcacagataaagacaggacagtagtatttactgtgttaaggtactggtttcccagatatcttacagtgagaagacagaagctcagaaagtgtaagcaatgtgcatacttgttggagtctggatgtaaacagagatcttgatgccaagcctatggaactttgtctccatataatattgtctctttcatggataactgactgccatgtggcagattattcacgctattctgacagttatggctttaatatcatcttattttcccaatctattcaaggatcagttttgtcttattttattttgtttaattccaaattggagatgtagagaaaaatcacatgacgtttgatttgccagtctcctaaaaagaagaaaactatagatttttaatatacttaatttttttttctttaacaggtatgtgagaaagagagcagtcccaaattggtggaactcttattgaatagtggatctcgtgaacaagatgtacgaaaagcgctgacaataagcattgggaaaggcgacagccagatcatcagcttgctcttaaggaggctggccctggacatggccaacaatagcatttgccttggagggttttgtataggaaaagttgaaccttcttggcttggtcctttatttccagataagacttctaatttaaggaaacaaacaagtaagtaacaaggagaatatttttgacagttcttatttttaatagtatttttttaagtcactagtcttttagtggttattcatgccagtttgaaggaccttaagccaaaaatattgcaaaggtttggatttttttggctatgaaatacttcaaaatgatgtatttaagttctttatgagatagcaaataggtacttataaaattagagcaaaatagcggaagctttttgaagagctactttttaatatagtccttttttatttttaaagtaaagcatccttgtttttttaaaaaaatataaaattataaaaaagaaaataaaaataacttattttttcccttttaagtaattaaaacggatatttttcctaactttttgtatgcttacatgtacctatgcattcaaatgtatgtaaaagcatacacacatattcacttggcatttttaacttagcatatatatatttcaattgataatgcattttctttatacattcaagctcatatgtattttgtacatattatgtgtattgatggtaagttgccatcctctgacactgtttttgtcttttgagctctttcatttgttcacactaaatgtgtttttagcgtgtgagctcccagctttttctatgttaatttagtctcatgcccatctccttccccatggtcatgatactccatgactcaacacctttaggaccattttgcaaatagcatgtttgcttctctcatttttatgatgcactcaatagcaaaacaccagttttggtcagtctactagtctactttttccctcactttcaccaagataactgagtgctgctagagaaaagtacccgtccatgcaatttggtgcctttatacatcaaggtttccaacctctcagtaggctccaaaagttccagtcaggctgaattttcctcggtttctcaaacacttcatgtacccttacttccagtctttttccattgttactctctctacctaactctaaattctctcttcacctggctgtctcttcattcttcctgtctcagcaccatcatcagtctggaaggtcctcttacatgaccctatagcaccttatttctcacctatactaccattcaccacattatataatttaatttttcatttttattatctactttttggtagattgttagtaccatgaagtcaatgtcagttttgttcatggttgtaaccttaccattgatacgagtgctttgcacatagtagattgtcatttagaattaaacatttaatattggcaaaaataaaaattatgtaatacattatgttgctaagcatatgtggaaacatgcttcatacattgatatgaatttaaattgtcctcttttgaggacaatttggcaatatccactaatattttttaatatacaaacatacttttttgacctagcagtgtactgttaggaatctatgatacagacattctcaatgtgcacaaaaaattatgtacaaaaatgcacattaaaacattgtttataatagcaaaagagtagggaaaaacctaagtattccccaaaaggaactattcaaataaataatggtacattcatgcagtggaatgctttgcaatcattgaggaaaaaaaaaacatatagcaaatttaatgtcttgataaagattacattactccatggcaaaaaacaggcacagaacagtgtttttactgtgctaatgttgatggaaatgcaattggaatatgatagttacaaaagtttgaatatgaaataaaaccctccagaaatggggtccctgattgtctctggggtctttggaaattactgagacatggttagatcccatgtttcattacttaaactagtctcatgccaaaaatctgcttactttaatcttcgctgtctgatagagaggaattgtgggcccattggagaaggatggaggagatttatcattcactatattccctttgctgtgtatgaagtttttaccattgacacatcttacccaattaaaagagcacagcaatgtcatttgattaattggagggtataaccatgatttcattggcagctggtctgagtaaagaacactttgggtcatagctttcaaacatttttcaggtagtatttgcctgagtgacatatatgtgtgtgaactcatcctgctgggcttcgggataatttcccatatcgtaacatattactctggaaaaaaagaactatttgggtatatgggtatagtgtaagccacagtatcaaatgtcttcttggggtttatcatatgggctcaccacatatttacagtaggaatagatgtagatacatgagcatacttcacctctgctactataatgattgctattcctactggcgtcaatgtcttttagctgatgagctacacttcacggcggtaatatcaaatgatcccccaccacgctctgagccccagggtttattttcctttttacagtaggaggcctaaccagcattgcattaaccaactcatcactggatattgtactacatgatacagtggtatccttaactttgttaaaggtagtaatgttaataagatatttggtaaaaatggagtgagggacttttttgttaatatagtatgattgaaaacattggttgatagaataaggatatttgagagggcaaaaaatgagagttgttccaagatattgtgtctcaagtcaaaccatttttaaaaatcaagtgtagtgacttatatacatatataatttatataaaataaaatgcatatatataaattttatatataatttatataaaattaagtgtatattttcatgtgctttgaaaattaccactgtatcatgtagtaatatttgaagtaattacagtagtaatatttgaagaaatcttcctggctgtatgtagaacaatgaggactctgtcaacttattcttcatagtagagctgatatataatgtaatgaagttgtgagaagaatgttaattttgaaattccatcaaatttcccaatagtcataatgaatcactcagcaaactttataaaaataacaacatcctttatttagtattttttgtgttctatgcattgtgctaaacattttatatacatggtttcatttactcttttccattaccatatgctgtgtatgttatcatcttcattttccaggtgaggacactgacacccatggagcttatataactcacaaatggcatttctatgacttgaacacaggcctgtctggcttcaaagcctaggccttttcctgaataaagttccatagagattcaattttgctatctacaccaaagcattgtatacatggttatgtttttttttaaaaaatatgatctgccacctgctaattatttaggatcactaatgtaaggtgactttggaaggaaaaatagaaattttctctagaagcataggaatacataagaattttggtcctatatatgtttatttttgcataattgttgatttctaagttcctggtgcatctctttattttcagatatagcatctacactagcaagaatggtgatcagatatcagatgaaaagtgccatggaagaaggagcagcctcaggcagtgatggaaatttttctgaagatgtgctgtctaaatttgatgaatggacctttattcctgactcttctatggacagtgtctttgctcaaagtgatgatctagatagtgaaggtatttattataaaaagaaatccctttatgttttacatttacacactgacattgaacaataggacccgagacaaaaacctgacttaaatcatttggaaaaacttaagtagaaatgtgtttattatcacaaacggttaggtttactaattttggtcaaagtgatgtttcaaggaagtgtgtctctgtgcttctaaatgttattctgactaattggttaatggttaatattccaggaaataaactctgactagactggaacgagattccacactctgacactgactaaatccttttgtggcttgtgtaagctccttaactttgttaaaggtagtaatgttaataagatgtttggtaaaaatggagtgagggactttttagttaatatagtataattgaaaacattggttgatagaataaggatatttgagagggcaaaaaatgagagttgttccaagatattgtgtctcaagtcaaaccatttttaaaaatcaagtgtagtgatttatatacatatataatttatataaaataaaatgcattcactttaagtgtatattttcatgtgctttgaaaattaacatattcatgtagtcatcatcgctattaagttatgcaatattttcatcatccaaaaaagtttcttcatgcctcttcactggaaccgtccccttcccctgcccctgtcccttagcaatcatttgcttcctgacactgtagattaatgttttctctagttttatgtacatagaatcatacagtaagtactcttttgtgtctgttttccaaagtggttgtactatgttctccctccaccagcgatacatgagcattctggttcctctacatccttgtcagtacttggtattttcaagttaattttagctcttctagtggagatttaattcatttggatgtaattttcatttccctaatgacattttcatgttcttattggccattcttatttttgtgtgaagtgttgaagtattttgcttttaattgggttgtcctacaattacataaaagttctttgtatattctagatagaagttgtgacaggtgtatatattgcatatatttttttcccagtcatagcttgtcttctcattttactaattctattatttttaaaaaacagaagttttaaattttggtgaaatgcagttttccagtttttttcttttatggtttgtcctttttctataccacttaagaaaccttttcttagcctaaatttgtgaatattttctcctatattttctcttagaagtgttaaaatctcagctttaacatttaggtctaaaacattttaagctgatttttgcatgtgatgtgtcaatgaagggttgacacttatttctttctgtgtggatatccagttgttccaacattacttgttgaaaatactatataattcctcattgaattaatggaagctttgttctctttaattgactatttaggtatggttctactttagcattatttattctgtgccactgatttataccttattcttatgccaaaaccacactgtcttgattactctggcttactagcaggtcttgaaatcaggtagtccaagtcctctggtgttcttttaaaaaaattgttcttattaatctagattatttgcatttccatataaattttgaatcaactaactttatgctgggatttttattgtaattaagtccatatttggattttatattgaattaatttataaattaaatcatattacctgtaatgttaatataatctataccatataattaatacataaataatttctatagattatatctgtaaatcaatttgagggaactaatacattaataatgagtcttttgacatattaatgtgatatatagttcaattagtcttttaaaatttctaacagtgtgttgtattggatgttttctgatgctgttatagatggtattgtatttgaattctaatttccaggagttcactgctgatatatagaaatacaattcatttattagtacatgaattttttatccggtaaacttgctaagctcacttatgagttttccagtaccttattatagattccacaggattttctttgttcgtaattataccatttagtaataaagacagatttgctttttcttttctaatatttatggctccttttttttttcttgtcatattgcactggctaggacctccagtactatgttgaatagaatcagtcagactgggcaccattccttggtttccaaacttagaggaaaaacattcagtctctaatcactaattatgacattatttgttatttttcatagaagccctttatcaaattgaaggagcttcttcctagtcatttttggagagccttttttttttttttaatcattaataggtgttgaaaaatgctgttcagcatctgctgaggtattcatatttttcacctatattttgttaatatagtcaaatacaccgactgattttctaatgttaaaccaatttgcattcctggagtaaatctcacttggttatggtacattatcctttttatatagtattaaattttattttctaaaattttgttaagaattttgcatctggctgggcacagtgactcacgtctgtaatcccagcactttgggcggccgaggcaggcagatcatgaggtcaggagatcaagaccatcctggctaacagtgaaaccccatctctactaaaaatacaaaaaattagctgggcatggtggcgggcgcctgtagacgcagctactctggaggctgagtcaggggaatggcgtgaacccggaggtggagcttgcagtgagccgaggtcatgctactgcactccagcctgggccacagtgcgagtgcaaaaaaaaaaaaaaaaaggaattttgcatctgtgagagatattagtctgtagttttatacttccttgtaattatgggagtaatgctggcctcttgaaatgaattgggaagtgtttcccattccacaattttctagaagagtttgtgtaaaggtgttttcttcttaaatgtatgatagacttcaccagcaaaggccatctaggttttaaatttttgtggggaggagatttaaacttatgaatttaataactttgatagatgtatgattattttaattttcttttacttcttaagtcagttttagtaatttgtaactttcaaggaatatgtccatttcatataagttgccaaatttatttgtttaatgttacttatagtaattatttaattatcctgttagtgatttagttatcctattaataatctcttcaaagaatcagatttttgttttattgattttctctattgtttgtgttactttctcactgacttttgttcttatctttattgttccctttccttacttattttcattttaattgactttttttaaatagattcttaatttggaagcttagaactctggtttttagaaccttcttattttgtaacagaaacatttatttaaggctatatatgtccttataaatatcactttcactgcatcccagtattttgatgtgtcatctttccattcatttaaaaaaattttaatttcctttgtgacttctttgattcatgagttatttagaaggctgtcgtttattttccaaatatttggagatttttctggataactttttggttattggtttcaatttaattttgttgtggtcagacaacctactctgatgatttctatccttttatatttattgaaacatgctttatggattattatatgatctgtcttggtggtgtgccatgtgcaactgaaaagaaagtatattcatctgttattgggtcaaatcaataggccaaattgtttggtaaaatttctcaagttttctgtgactttactgatttttctttctatttattgtatttgaaagagaactattgaagttgtaattgaggatttgttggtcgtcttttcagttttatctgtttatgctttgtatattttgaagctctgctgtttgttgtgcaaacgttaaggattatatataaaaaataattttttaagtgaaataaccactttatgttaatctaagtttgcagttagtatcattttcttcttctggaagaattcccttttacatttctagtgcagatcttccagaaacccatgtgcagattactggagctatttttctgtaactgccccagaactcccagctattgtagtctccataaatgttgatgtctatctcctcatctcaggaaagccgtgagactgtttaaatttcttcttatgtgtatgccccttaatttgtctccaagcagaagaccagagtgatcatagggctcacataatttgttacccttctttcaggtattacatagtcctgtgctgtctgtcgcccagtgtctatatccagtcatttaatgtatttgtccagttttcttgttgtttatgtaagtaggttaagttcattcacatttgttgctctatcatgcctgaaagaactctcttcaagtatttttaaagaaaacattagaaattttaacataaaataattataaaatgcactatgctgcttgtacaaataatgtgctaatagacatttcacaaacatataaagtgggataattatgataatttaataatctttataattatgtaattgttactaaattataaattctattttattaaaattcttaagcattaaaataatttaaattatagaattaattgaacttcagtaatgaaccaggtaggaactgtttatatcaggatttatactgaatattataaaggggatatttggatatacagattttataatttggttttgaagtaaaatgaattctttgtttttctaagataaagagtaggggaatttaaaatcataattttcacaaatgcattcacattatttatctttaatatgatttatttattgatcttttttgtaaatttattattttgaaagtactgccttttccttattttataaaataattattgccagccaaatttattgtgtttattttaataccattccataaaagaaaccatgaaacatgaaattcagataggaatatattcaaaattgctgttaaataatttgtgtgattacaacatttaaagcaagatttgaaaaatttataagaaaaattcagggagttaatccactctctttcctttgctgctagatcctattccagtggtctctataaaaaaaattcagagaaacagaaagcagtaacattgatcagattgcatacaaactttctgcacacacacgtatttgttatagcttatgtaaccattgattgattttgcttttttctgctggactatgagctcctctgagggatagatttatttttttcctgcatatcattatccagtgcttacccagtgtctagtctgtaacagccattccataaatatttatggatgaagaaaaatgttgttgaatttttaaagtgaaaaaccaacatggcttatcatttctattttaaagattttacaaaggaaatggactgtgaaatttccattaataaaaataggtttaatcttccatgactgaacaaggaccttatgattgagtaagcttttcatactcactttcatgttactttatcattttcaaaataggaagtgaaggctcatttcttgtgaaaaagaaatcaaattcaattagtgtaggagaattttaccgagatgccgtattacaacgttgctcaccaaatttgcaaaggcattccagttccttggtaagttgaattgtgattatgttgtgttttgctactgacattctcttgataactaaaatttatgccaaagctaggaacaattggtagggatttccctgatgtatgaaaactataattttgagatgttttctatatgtatatatatgaaaacacagtagatgtaaattatgctaaattcacatttgtagtcttttgagtatgcagggtatgaatttgtttggggcatatatatgtatacttgcagtacacttcaagatggttttcttcttctttcttttcagaacttcatgtctgaaaagagcccaggctagacctgtacctaatggtcccatgaacactttagctagaaaccttacagtgatttctaagaaaccagacagaagtctgaaggacactgaacaagatggagtagcataatataattcattgcttatctttgtctatgtctatatctatatctataagtgtattgaaagttatttaattttttagacaccattattattatttcaacctcctatctgttttggaactatagaaggactattgcatatttgcatgaggagtttgatcattctagttgaggaaattgggagccaccttattctcaggttcactttgaaggatctattctaacctatgctctaattttgattatagctgaatactaaaaatatcagtgtttttatatgttaattctagaccttaagatgggtgaaatgaatgactatagttgaatcggttaaattagctctcagctttatatatgctctttcgaatttatatataaatttagttataaaaagtagtttggttaatgagagaaattatatagatatagctttttgactcaacctttctgtttttcagtttccttatatttaaaacaaaagagaaagagtagatactaaggtcatttgagcacaaaactgaattgttttcttttatcttcataattgggttcttagtttttacttgcctattttttcccataattataaataccatttaaccctattaaaatttcatggttctttccttataaaaatgtcctcttgtccaacaagtgacagcaattttattataaatatcattttttttaataggggcccatttttgatcatgaagatttactgagaagaaaaagaaaaatattatcttcagatgattcactcagtaagtatttggatgtaatcataagtaaatagatactttgggcagaatacagtgtttggttgaatttcctccaattattcaaatattcttggggccagtttcatcttacataatttcccataagctatagaaaaatgaagtatacatttaaaatttacctttcttgaatattatagaacacgttagtctttatttttacaagttttctgaagtgtaaataacacctcccaccagtgccactcttcatcctctcttccagttttctttttctttttcccacaccatttataccacctgattaaacgctttttatctactgttcatctctgccactggaatgtaaactccatagtttggttttctactgaatcttcagtgccctgaagaaagcctgattgctaggaggtgctcagtaaactttcactacatgaatttaaattatttgcttatatttccattgtctgtctgtttttgacaaaagggtcatcaaaacttcaatcccatatgaggcattcagacagcatttcttctctggcttctgagagagaatatattacatcactagacctttcagcaaatgaactaagagatattgatgccctaagccagaaatcctgtataagtggtcatttggagcatcttgaaaagctggagcttcaccagaatgcactcacgagctttccacaacagctatgtgaagtaaatttaatttatccttgtaacttttaagacgtttgaagagcttttgtatttatatctagtttgcctgattaagtcttttaaaagaacattctgcttttgtgtcactgggcaataagtcccccgttcttctggtttttgcacacatatcttagtctgtgtgatgttcaggagcatctttgagggcaggccgtggaaacagatctgattaaaaagaaattctaggttttgtacagagtacatgttaaagtctatcaagtgtatattgattaaactttaatcatttaattcaagtaagacaacgtcaactatttaaattagattaggtaaactagaattagacctggtttggtagtactggctctgactcagctacaactgtgtgacaatacgaacatgtcactcctcctgctctaatctttcattttctcatctgtaaaatagagattcaactaaatgattattgtggcttattttttttttccagtttaaaataatgtgtaacttaaaagattttcatttttggtcaaagttcctgtcttataagaattaaactataatatagtttgttgataggatagctctctgaaaattgactttgctcaacatttgtatgtactacagatcaaaatagttttgaaagccaaagaagatatgaaaattaaaattattttaatgcaaatgtttaaattgttaaattaaattctcaaggctgggcgtggtgactcatgcctataatcccagcactttggaggctgaggcaggcggatttgtctgagttcaagagttcaagaccagcgtaaacaacagcaaaatcttgtctctaccaaaaatacaaaaaattagccatgtgtggtggggtgcacctgtggtcccagctactgggtgctgaggtaggagaattgcctgatcctgggaggcagaggttgcagtgagccaagattgcaccactgtactccagcctgggcaacacagtgagaccctatctcaaaaaaaaaaaaaaaagtcttgttgcaaatgcatttccccctttttaagtctaaaaaattatcataattttgagatgttttaaaggcaatattacataaattttaagtatatttaaggggtgtttttctctgtaaagtttttatatctggagacagagagaagaaagaaaggtgacccactcctccagccatgctgtaatgtctaaaatgtgtctttctctcttcacctctttgccttgctaaatacttcaagtcacccagggctcaatttaaatgtcacttcatcactctctgcttctcttcctttttccttctaccctccagccaacctggccacctaacctccatttccataacacatgatgctttccctctaattctcattcagtcatccaatttgatttaaagtacctttgccttcactaaactgtgaactccttgaggacaggacttgtttcaggcttgtttctgtctattcccagtgcctagtgagacctgacatatggtagaagtttagtagatacttactgaattgatttgtggaggcattaatgcctgaaacttggtaatacttcaattaatatttgttaaatgagcaagtgaaataattcagagatttagtctagttaaaacaaagagaattggaaggctgggcacggtggcgcaagcctgtaatcccagcactttgggaggccgagacgggcggatcacaaggtcaggagatcgagaccatcctggctaacacggtgaaaccccgtctctactaaaaaatacaaaaaactagccgggcgaggtggtgggcgcctgtagacccagcaactcgggaggctgaggcaggagaatggcgtgaacccgggaggcagagcttgcaatgagctgagatcacgccactgcactccagcctgggcgacagagcgagactccgtctaaaaaaaaaaaaaaaaaaaaaaaaaagagaattggaagagatggtgataaggtgagacatgctggcattcaatgactggacaagctcagaaccttctcttagggaaatttcaaaatgacaccattagatggtactttgtttgtttgtttgttattgtcaaagagtctcaactatgttcctttttataagaaaattttctgattaaaccctgggaataattttaaaatctttactttggaataagttaataagggtctgaaacaaaggcaggaattttgaaacaacttctgaggcaaagagtcattaataagcctctataatcatatcaaagtctagaatttcttgtgtggataaatatactgatatataaagaagaacatagagaagtgattgtttttggcatttgagctctttaagagtattacatacaaagttgtaaaaagtcgacataatatgtaagtaggggtttgctgttatcattgtaaaattataaactgcttaaaaatggaaagtagaaatttgaaacaaaaagtttcataaaaaagaggaggttctaaaatgaaacacatattgtatgtaactatttttatggttaaatcttatatatatcaaaatatgtaacaatttctgacagcatttaaaacatattcccaggattatgttgtgctttttcttaaatcattaattcaaatatttgctgaggcctattctgcttccattttgctctttctggaaataatttacaaaaaagctgaaggaagctttcaactctattttcatgaacctgctttttacagtctaccgttgtaattttgctggttttacccatgctataagcagaggtgattgggctaatcagtatactgaaattctgttgtggattgtgttttcaactttttgaaaattcttgatggttctagttatcagaggtgtgtaaggcagaaatattagctagacttaagttcctcagatggtccactttagaattttaaactcttgtcttttcagactctgaagagtttgacacatttggacttgcacagtaataaatttacatcatttccttcttacttgttgaaaatgagttgtgttgctaaccttgatgtctctcgaaatgacattggaccctcagtggttttagatcctgcagtgaaatgtccaactctgaaacagtttaacctgtcatataaccagctgtcttctgttcctgagaaccttgctgatgtgatagagaaactggagcagctcattttagaagggtaagaaagagctcattaaaaataaaaggactgcctaaatatgctgatgttaacaaaatacgctgacatttgtatagtcatgagttttgacaacatggtgaaactccatctctactaaaaatacaaaaattatccggggttgttggtgcgcgcctgtaatcccacctactcagaggctgaggcatgagaatcgcttgaacccaagaggcggaggtcgcagtgagccaagatcgcgccattgcactccagcctgggtgacagaggcgagactctgtctcaaaaaatatatatatatatatatataatatatttattataatgtataagtattattatatataataaaaaactgagacaatgaatattacaacttttatcaatgacttacattttcacaactaatttttaaattaatgagtcctcttcgatgctattcttcgaaaacaaattgtttttggtattttttctttaaagcatatgaatttatgcagtttaatcattatcttgtctcttgtgactagaaataaaatatcagggatatgctcccccttgagactgaaggaactgaagattttaaaccttagtaaaaaccacatttcatccctatcagagaactttcttgaggcttgtcctaaagtggagagtttcagtgccagaatgaattttcttggtaagtgttctgtgtgggtctcctccttaccaggccctctaagttgtacaagatgagtcacatatggaccctttaggtggggattgaaaggtggcatttcagtttaaatattatgctggatttaaaaaataaagtcagcaggttggcaataaaagaaaatgctatcaaactatgaaaataaatgaaagaaatgtaaatgcatattgctaagtgaaagaagccaatctgaaaaggctacatactattcgttccaaactataagacattctggaagagacacaattatgaggacattaaaaagatcaatggttgtcaggggttaggggagggagagatgaataggtaaagcacagaggatttttagggcggtgaaactgttttgtatactacagtgggggatacgtgccattgtacacttgtcaaaacccatagaatgtacagtacaaagaatgaaccctgatgtaaactatggactttgagtgataatgaagtgtcaaatattggctcatcgattggaacaactgtgccaaactaatgcaaattgttaataacaggggaaaatatatgtggggtagtggtggtgagagaagggatatattgaaagtctttggactgtctgctcaatttttctgtgtatctaaagctgctctaaaaatagtctataatttaaacaaagttatcacatttttattgtcagaggttaaaatgatagttacttggcctactgtgtagtgcactgtggttccttttagtcttcaactaaacatgactgcctgagctgggtaaggcatccttatactgaaatactgtttttcatactgaagtttcttcagcaattttttgtatgataaatatgattactcttattgctgttgttagaaacaaaattaatcatttaatagttttcaatttagtgaagttaatgtatattcaatcagcccttgtgctttgtaagacattacaataatgcaaattattatcatcacttttattaaaagttgtagaatcccctgcattctcttagcttatgaaataatagaggaaattatgttcatttgtatcctaaatgaacattttaatattaaggaacaaaatacttttatgataataaacaggaattccccatattttatcttccttcatagagaatactcacttcttgccacccatgtgattattctatacctgactcagtaaaataatttttaattctatttaatagcagaatatggcttgactgcttattaatggtattttaatttgtcagagctttcagaaactaataatgatcaaagccatcttaatttggatagtattttcctcatttatccctccctcccttcctcctactctcatgaatattggccacattctaactatgatcctgaaactggagatagagtgattcactcactcactagtaagcaaagcaaacttggtctctgtccttaaggaacttgtgattaagttcagaggacagacaaacattaagtaatgatggcacaaataaatgtaattttatattgtggtaccttctgtggaaaagtttcaggatgctctgtggtacctcaggggaatctgattcagactgtggagtcagggaagcctttctgttcctgtgacatttaagttgggtctggaaagaggagcatccaaaatgaccctgaagcttgtgtatggtcagtgtgtcatctcagctgaatctcacaatgatcctaatggtcgtcgtacctaggacaggtatgacctctgcccagttgaggaaattgaagcagcgagatttttttgtgtgatgtttacaggtgcatgtaattaattatcttgtgaaagtttgaatgggccccagttcaaaatctgtttgctttgcactacacaagcttaatagtttgaaaagtggtcttacatttgagaagatgccccacggaggtgacatctgagcaagaccactaaccattaaaaaataatcccatgtaaatggtgaaacctcgtctctactaaaaacacaaaaatttttagttttttttagtaagcgtggtggcatgtgactctaatcccagctactagagaggctgaggcaggagaatcgcttgaaccagggagtcggaagttgcagtgagtggagatcatgccactgcactccagcctggtgacagagcaagactctgtaaaaaataaataaataaataaataaataaataaatcccatgtaaaatatagttttagttttgtggccttatgaatgttttccatacaacatatgaaactcaagactctgaagtcttaagtggagaatcatttctactcatttattttgccaataggtgaggtataatatgtatcattctgcttctcaggaagacagcttctgggagtgtcctggaacattttgacccttgaagattgtctagataaatcataacccgtattttttaaccttgaaaatgctaataactaattcctcaagccattttcacagaaccgtagatttgtagatatttcacgtatctcagcgttcatctgatctagctgcactcttttacagataagaaaacaggctgtgtgattttctgtttcccaaattgtgtttcacagaattttattccttggaggtacctcatactgcatttccttcttaagaattcacaaaataggccgggcgcagtggctcacgcctgtaatcctagcactttgggaggccgaggcgggcggttcacgaggtcagaagatcgagaccatcctgnnnnnnnnnnnnnnnnnnnncgcacctgtaatcccagctactcaggatgctgaggcaggagaatctcttgaacctgggaggcagagattgcattaagctgagattgtgccactgcactccagcctgggcaacagagagagactctgtctcaaataataataataataataataataataataatgtaaaaaataaaaaagtaaaaaataaaaaaaatcataaaatacaccagagttttgagaactcagatattttactttattttaccgaatgtttcccaatctcttaagattatatggtcaaagaatactttcattaaataacacccattattattccatagaacactctttatgagctagtactataaataatttttgtccttataatatgctgtatattagtaaagtgttcaaagttgttttgctatagttatttaagagtaattttagttaatctatatgatatataataacatcacacataatttgaaatgaatattctaataatttttactttgtacaaatgttgggtagttaaatttatatttaaatagctgtttagcttccaggttaaaagattctggtaagtatggcattttgttttattgtttagtggaagtattaaggctattactttatttttaaaagtggatttttaaaaattgtcagtgtgagaatggaaattaaattaaattaaacaccattggtagctgttcttatttttgaatttaatggaaatctggttaaaatgattaaaatgtttatctcattttttttcttttagctgctatgcctttcttgcctccttccatgacaagcctaaaattatctcaaaacaaatttacatgtattccagaagcaattttaaatcttccacagtaagtttattgtttttttaattttaaaagcacatcagctggaacagaacctttagaaacatgatttcgattcagtcatatggaggtaattgctttctaaacctacttagcttaatgtttttgtgtgtatgaatgattttcacttgataaaagacccaactcattacttaaaatggaaacttttatattaatttagtggatcattgtgtaaaaacaacttaggattgtttaattaattgctgtattagtataatgaaatgagagtatactggctatcactttaacttttaaaatgttagtggaacttgatatgttgccagaatacccttaactttgacattatgcttaagttgtgtttgagtgaaattttgggtgaagattaggcaagtttatgtagttccaggtttttgaggtattttggttaatttcatgaaaccagaagtttcctgttaactttaaattgaggcattaatttgatcttgattgtgttgtaatcttaaattctattctaattatatcatacatgataaaccaaattcataaaatatatgtgtaaatctatcttttcctttgttttcttgctgtcagctattccttcaaacactgtggctttttagaattaagactaaaatgctacttgcatgatgctgcaatgaactcttctgtgagctcatatttagggaaataataattataatttagccatagagagtgttacacaaacctataatagctaacttacatctagctttagaatgtgtcgaactattctaactactctacagcggttcgcctctttaatcttcctaataatcccctacaatagccactgttattatctccacttcataagagatgaagtaacttgcccagctcatggttcttaaactctggtggttcaacttcaggctctcaaatcacatgcatactcatatgtcaataatgctagttttgacattacaccttattctcaccctgaggaaaattatttgtgatgttatttcatgtattttggaaatactcatatgatttacatctttccattgtattgttttagcttgcggtctttagatatgagcagcaatgatattcaatatctaccaggtcctgcacactggaaatctttgaacttaagggaactcttatttagccataatcagatcagcatcttggacttgagtgaaaaagcgtatttatggtctagagtagagaaactgcatctttctcacaataaactgaaagaggtaagatgtcacttttaaaattattgccacttaaaaaatatactttatgatttgcatcatcacaaattatcattttaagtgatatttagcttctaaataccagtttcatgaaactagaagcttcctgttaactataaattcctgtcaactataaattcagatttccattaaattcaaaaataagaacaactactaatggtgtgtcacttaatttaatttctattctcacactgacaatttaaaaaaatctgcttttgaaaatatttaaaagtagtagctgtaatatttccactaaacaataaaacaatatacaatacttatcagaacctttcaatctgaaagctaaacagctagatataaatttgtctacccaacatttgtacaaagtaaaaattattagaatattcatttcaaattacgtgtgatgttatcatataacatattatagattaactcaagttactcttaactgttacttaactatgacaaaaaaacttagaatgctttactaatacacagttctgtatagtactagctcataaagagtgttctatggaatagtagttgatgtcatttaataattataaattcaaaataagcattgtaaatatcaatactattcaatttttttggtttttaaataagttctaagcctacccaatggtaaatggatatggtaacacagcgtaatttccttaaaaaatacttttgtgctatattttttaaggattatatgaattatacataattatagattaatgttatgctgtgtgtcattgtatcactaaatctctgtccaatctgttaacagactcttagatgctccatttttctcaagttgttgctggcctgtgtactatattacttgtttttcagctttctttggtacattcttaaatttctgcattcctgcaccatgctacctatcaccctaatggatcaatctttttgttttgctccattctctctgttataaatctgaaattgataatctatttgtctcagaaaatatatttttttcaagttctagcgtgttgcctacaaaaccaaaagaagtaagtgtctgacactgaggttcagaaaaactgtgcatatattttgctacctgattttttgccagcaaatgagtgttttctattataaatacagtatatattacttaaaaatttggaacagaagagaaatcactccaattaggatgccgcctaaaatataagcatgttgctttactttgagaatactaaattgcgtgcaggtttgtagtgactctaggtcttctttgctttactgaaggagcagaatgaagccacagataatggatttggataaccaaatccattttgtggtaagaacttccttactttcaatgtcttgaagagatgaagtatgttaccaaaggagatggggttttttaagattacagatgagtgacatagattgtttgggagtaagtttttatatgtaagttttcatgtttttaaacacatactgacaacttatgacaaacctttggaaagttttagaactctgttgaaagattgtgcaagctgctgatggaatctgtgagcctttcttgtttcttatcatcttgttttttggcagaatacatttcttccttcccaccaacagcttttgcccatttttttccattaagattcctcctgagattggctgtcttgaaaatctgacatctctggatgtcagttacaacttggaactaagatcctttcccaatgaaatggggaaattaagcaaaatatgggatcttcctttggatgaactgcgtcttaactttgattttaaacatataggatgtaaagccaaagacatcataaggttagattttttttttctatttgtttttattaaatttatttcagattttctactttctgtgactttgatggacgtacattgttacaatttagggaaaaatgaatagtaatatttggcattaatatgctgtgtcatttgcctttcatttaatgaatgcgtttctgtggtgccactgtagagatttttcattcttcttagccaggctaatgttgagagcagcttctcctccttctgtttcttttcactggagtagactctaaaagaaaataagtattgtgatttggtctcttgattacacaatctaaagaaatatagcacagtttaataacttctcacactgaatttcatatagcaactaggtaacatatgcctcttacatcttaaagtattatcattactgacatcatatgaaattactaacttctattttgcccattaggatgagtaatctactcaccttgatcagttttgaaagcaccaaaacttctcaagtatcactgtttctggtctttacactctaagcactttaagtgtctttgataatggattttatccccctttttattccctttcagcacattggtcttattactttctcataaaatcctttgctcccttttccacagttactgtatgaacattgcagacctcatttctgtcatcacctctcaacttgaccgtaatatcccccaaggcagagactatagctgtgttcagtcactattcaaatcttggcacccaacacagtgcctggcatacaattagtaattgtttaattaccagtgatttatacttactcattctcttctgcctaaaatctcttaaatttgtatttaacttcatctctttttatgaggaaggattttgttttctgaactcctcctgagcttgatttcattttaaaggaaagaatttgttaacttttgtgctaattgtgactacccttcatcctacacaattatttttctctcttgaaactggaaaagatggttatataaaaattggttcaattcttactaaacatttagtagaactagctttcagtgtattatactgtattatcaaaatatatatctaaatatttttaaacatgtttaacattttcagagaagacagaaagacctggagcaagttagaaattgtaagcatcatttgctttttgaagaaagccatttttcgaatagtggtgcattcttaagaaataaataaatcaagaaaagtaatcttttttggtcatatcatcaggaatgttggtgagattcttattagtaataggaatgaattggtcactactccgatgtagtgacttatgatttagtctttttctctaatttgagactgtggcaacattttaacatatttcaaaatgtatctttatctatccattatatttttgataacactttaaatctattagtttaaaggtagtttttaagctacctaaacacttctatttagttcagtttttgcattaagatcattagggatgaaagcttgttaacagttgctgatagtataatagtttatatttatttatttatgaagtaaggtgatctcactatacatatatactattatatgcatatgtgatatatatgaatacatatctatacatcatatataccatatatgtgtatatatacacacatatataatgtaactaatatgaccttgttatcaagctttattataacagtatacatatatgtataccttgtttctatgtcatatggactttgtgaaattttatactttataatttatagggtttttcttttcttctttacttttctttttgagattgagtttcactgttattgcccaggctggaatgcaatggactgatctcggctcactgcaacctccgcctcttggcttcaagcgattctcctgcctcagtatcccaagttgctggaattataggcgcctgtcaccatgccctgctaattttgtgtatttttaatagagatggggtttcactatattggccaggctggtcttgagctactgacctcgtgatccacccgcctcagcctcccaaagtgctgggatgacagacatgagctaccacacctggcctgtaatttacagggcttttcatactatttaaagaaattcaaatatgtatacatgtatgtatgtatatgtgtgtatatttagatgtatatatattgcatatcgtattctaattagtattgcaaatgtattttggccttttgattatttctggcgatagtgtaacattttttctttggtgattttaccaaatattatcaaccacactaaaatctctagcaaaatatatgcattaacagtactctgaaagacatgtacattattagttatatgagctatacagtcttttggatattatattttagactagtgtgacatgcaaaagaactcacctaaatcttaagtgtacttttcaacagtttattattttatttttatatttcaaatactaggtttcttcagcagcggttaaaaaaggctgtgccctataaccgaatgaaacttatggttgttggaaatactgggagtggtaaaaccaccttgttgcagcaattaatgaaaaccaagaaatcagatcttggaatgcaaagtgccacagttggcatagatgtgaaagactggcctatccaaataagaggcaaaagaaagagagatcttgttctgaatgtgtgggattttgcaggtatttctttctatagaattttaaaattcacttttaccatttgttttgaacagggattcaaaaactgaactttctgttctaatatccagaaacctggtatactgtatagaattattccaaagccctttacttctcctaattttacccttgcctccagaatggaggagaacatggagggatatgttggtaacaatacggtgctaggtattttgatcggttggtgccatatatgctaaaagtggtcaatcccttgtaaaaacccagaatagttctctaaacattatctgttgtttttctcttattagtatgctaaataaaaaatagtattattcccccagatatttttttaaaaagagttcttgcctgttgtttgaaagatttaaaaaatttgtctctaatctttatttaggtcgtgaggaattctatagcactcatcctcattttatgacgcagcgagcattgtaccttgctgtctatgaccttagcaaaggacaggctgaagttgatgccatgaagccttggctcttcaatataaaggtgatttattctgatcttttgaaaatagaaaattgtgtgtgtgtgtgtgtgtgtgtgtgtgtgtgtgtgtgtacacgttaatttattttgggcaaacagttgcttcagtctctttaaatacttccttaaaagaagcactaaagttttgagttgggaaactttcagagtaattaaatcataacatgaaaatggtatgttccatattggtgaatgttattgataacccgaaattcttttatgctgtgaaacttgaaaatatatatgttcaactgtttttttaatcatattatttcttaaatgaaatctaaatttttctaatttaaaataagctatattaaagaaaagcaatctatatatatcatcaacttcgtactcaggggccatttagtgtgaaatccttcagattgtatcctttaagtggtcccagattattatgctgttatgtctggaatctcccttttgttgcttttgtatcttttcctttgttgtcttgttgtcagctatgccttcaaacactgtggcttttaagaattgagactaaaatgctgcttgcatgatgctgcaatgagctcttctgtgagcaaagtccttaaaaaggcttgtgtcaggatatttaaccatgtcatttggctgcatacatgcttgttttgtaatttgggtgttttttaatgtttcttttattaacttttttacagctagccaacatgagcaaatattacagtggcagtcatacttgcttgaatggcttttattctttcattgtagactccaaattgaatgactttaaaatgaatttagaagattaaattcactgataaggaagagaaaatatacatgatatgacgttaatttgatataatttgtgggtttatgaaatgcttgttttatttaggagtggataactcatcttaaggcatgaagatgagaaaggaaaactatgctactaccattatataggctacctaaaagggataaaaattggattaaggaaagcctaaaaatgattttttaaaatgtcgaggttacgttgttttcttaggtttaaggaaaaaaggacagttgttcttctcttcttctgaagtctgttagtttctcttttccactcaagtgaatgtcacggaaagcaaatatcaacaggaatgtgagcaggcccaatttgaaagcaaacacaagagggttttgtgtctttccctccaggctcgcgcttcttcttcccctgtgattctcgttggcacacatttggatgtttctgatgagaggcagcgcaaagcctgcataggtaaaatcaccaaggaactcctgaataagcgagggttccctgctatacgagattaccactttgtgaatgccaccgaggaatctgatgctttggcaaaacttcggaaaaccatcataaacgagagccttaatttcaaggtaacatggtaggctggtagagaaacgtaatttattaattctcatgttatacaactgcctagaaatgtcagaaattttgagaagtgagcaactcacttaaaattgtggggtttctttccccattgctgttagcattgttaaagtcttttccattttaaaattatttataccagacttcatttctaattcatagaaatgggaataaaaaaataattagaggaccctgagagaaactaagagaacatttctgggatactgagaaaatgtttctgagagagaatctgagaaaatgtttttgatgtcttttctcatccaacttcttgtagtggtggttcagtccaagggtaaaggtgaatactgaggtcttgggatcatctttcttctattattctttgactgttatttttccatttgctcctttcatttggaattcctattttatggacatcttgatcctttgtgccactccttcatgtattttgtcacggtgattcccattccaattttttttcccctctgtattgtgaggcagctgttttatttagtcatgaagaccactgacttggttttcggtagtatctcactaattacttagttcatacaaaatggactttttattttaggaattatgttttaaatgtttaaaattctcttctggtaagccaaatctttataaagcataaataaatcagttatcagagacaaccctctttttttaatacttgcaggaaaaagaaatattcactgggatctacaggagtgtggtgtaaactgtactgaaaaatacccttgatagttccatatgacaaatataatgatgaatttcacttagtccctcttggcttagctcattagcattaatgatcaagatcctggctgataaatagagtcctatttcgcctgggcagtaccagcgtaattattaatagtgtcccactatattctcaaaagcattccaatttggatgataaattatatagtcaccttggttataactccgcgttggccagttagcttacataatccatttatatagattatgtgtgcttctctgcaaaacctaatgagccatttgtaaaagtgatggattttgcggtgtccggggagagaatttgtatgtttgtgtccttcagcacacatttattatagttattaaaaggttttattgatgatagacagtaatgtcatgtaaaaatgacattatttatttgtagattttcctattctcttgttggacatgtaattagaaagtaatatgacttaaagaaaaacaaatacacaaaatttattcatccagttaatctcttaatcgaggtttttttttttctgagactatacccatacttcaaaaactttgttgttactgagaatattttgataatttcccttttcgtcattgctgtcagataatgtatcatatctttaaaaagacttgttggaggacgagtttgttttgaaaaggcctgaatttagttgatgcaaagtcacagataagatggctcattaagctgtattaatactgcttttgtctaatagatatcattaccaataaatcagaccagatttccttttggcacttgtaaatcaactttgaagacaactttttacaaggaagtaaaacaaatgctttgagaaataccagtattagtgaaagaaaagtatatattgctaatggatgcagcattctggcataatggtttgaaaactcatttgattgctttgtagaagagtgactctttcggaggacccagggcctgtgggcctgccagaacttgaaaattctttcttccctgaggtgcttcaacctgaattcaaagagcagcttttaatctattagagatctttttttgtcctctcatttatttttcatctttccctttgatcttagctcttctctaatctttttctgtctcaaccttattaacatgtgtctgtgcagacactttaagttttatttttttgactcagcctgtcagtgaactgattatcatgctgaaaggagaagcaggacaatacagagttgaatgccgacaatactccttttaatcttgttcagcccattagcagagcaggcatccctttaggctttgagacctagtcccctaaaactcatcccgtttctacttgatttgctttctttgagaactcttgtttacttttatatggaggtttccctccttggattaaaacataaacctcaatctgaagttccatttcatcttaatttatgaacaactctgagagggaacatgaaaagtggagattagtgaaattatctccaattctctgggtcaaaagatacacgaaaacagtctcttgagtaaccatttacaggtaaatacagaagtaatggttattgttgtctccttaaggttttagtcacaaatgaaaaagaccaagttaattttttgtctctgtgtgctgaatttctgtttgtagtaagtgtaagaatttaagcagaaatgctgtttcttattttcaggtgaaaagaatatgtaatttccataggtccagaaatagggagagtttgccatctggtggttcttacaggcattgcggatgttattaagagttgcttttctatttaaaattatattttaaaaaatgtttggaagatacttttattatagaaactatcctcttaagcccattctttaaaaaatcttcttttatgcatttctcattttgtagacagtgattagattctaaaagcaacagaacaatgatcatcctctcctagcagaatcactggtgtttagatgatttctcattttcccaaattcaaggttccatgaacaacatagcttgagtgggatcttatgtctccagatttcactgttgatatatgcatcccatcaatataacattttacaaataacaagcacaaaatttaatgttttaccttgaatatttaaaatataatatccaaaagctcttgtaatttgtactgatatcttatgctagcgtgtctgtttcacattaagtttaatgtcttaagatataaaaaatctttcttatggttagtgatttatcttgatttttgccatggaatttctgtgtagcaagataaacatttccataccattttatttgatatttcctaatttgcctctggatcaacagttttcctattttaatttcattgtacttattccttacaatctaaatagctttttattatattttgattttatttaaaaatgtacttctgaataacatatctgtttctgtaaaaactgttagcactgaatttgccaaccatttgacacatacacgaataaaatagatttttacggcttgtcatttgtaatttcatagatccgagatcagcctgttgttggacagctgattccagactgctatgtagaacttgagaaaatcattttatcggagcgtaaaaatgtgccaattgaatttcctgtaattgaccagaaacgattattacaactagtgagagaaaatcagttgcagttagatgaaaatgagcttcctcacgcagttcactttctaaatgaatcaggtttgtgtgtttctttccttactttcaaagctcagctgtaataacttataaaagtgtttctgaatcttgtatagaatttacattcaaagctgagagaatatccatacagttctttaatagggcactgatttttttctttttggaggatcatcatgtgtgtggatgataaatcatgtatcatgttgtaagaaaacaaatttagaaatcacctaggagtaaagtagtggaaagattccctgagtgggagttaaaatatttgggttctagaacttacttgtactattcaggagctgtggaaccccaagcacaaccatatccttccataatgtcaaatgagtttagtgcatgtgaaacttatttttatattgcaaaggggaattattgttggaatggtctaactgggacgctttgagaatcaatggctccctgagatgatgcagctgctgagtggaagatctagctctctttcatcaaatattggtctcaacgatgaaaattctcaaaccaacttcagtgctaattgtgtacttgatcatattactttgccagaaatgtgtgagttgtttgatagtactagagtaagtgactgggaagctgcttttgatccctagattctgttgtgtgaaaaatagcttcctgtggtttatgatctgttccttttccccattgttcttaaggtatgctgaaatatgccgtgtttcttatctgtatttgaaaataaaacatgtctttgtagtgtttattcagcaagcaaaacagaaaattatgaatttctatgtatgcatgaaatatgctttgtaatgcatgtcagtgtctcaaatatgtttatatatgattgttttatgtagtttaaaaatactccattataatattgggactttagaccataggatgcacagcttctagtcccagctctgccactcggtatgctgaaatttctttacctgtaaaatgaggaagttggactagattctttctaaagccccttgatatttgttctacattccatgtttcactgtttgatgaatttttactacaggagtccttcttcattttcaagacccagcactgcagttaagtgacttgtattttgtggaacccaagtggctttgtaaaatcatggcacaggttggtgtcttttatttttgtggcacggggttatggtcaaagcatagaacagatggcgcccagagcattgagcattttagagtttgggtttagttaaggcagaaacttttgtgaatttagaagactgtggaacatttcacatagaagactacttgaagaacttcatggaagaaggaaagatgtcttgagttcacttccatgacttggttttccagccacatacagatgtttgtaacactctgtcccatgctgctttactagatcctgatgatgtcatcgatttggttactgaattagtcaattgaacgaaggctttgtggaaatccttggggtaaacacatagaagaaaattgggttgctgagcctgtgaaacctctatctagataacatggaggggagttttgacttaagtgaaatgatctgaactttaaatgcttatgattttgaaaactttggatggcgttggttatagctgtttttttcttatatttcacatggaaaatgtttttctctccgaatgataatccattaccagtgagtttaattagttacaataaaccatctctgtagctttgacataaaagaccatttgagcaaagcatactacctcagggcttttcaaccccagcatgatgacattttgggccagataattctttgttgcacattgtagcatgttggcagcatttttggcctttatattctagatgtaagtaatatcctttagctgtgacaagcaaaaatgtatccagacattgctaaatatcgcttggagaatgtgaaaatgaccctagttgagaaacattaagcttctgatttgctgatgagtaaaatttatagttttgcatgtggctgcccgagtccctaaaattattatatatttttatattagagatatctcttccaattaaaccataaaggtaattaaattcactcagacagtcttgaataattgttcctaatttcgatctgaggaaaaaaaggaaggtattgtgaagagagaacttagtcgaggctaaatccagtaccatggaactcgagagcatattgaaacattgcagtcagtgattatttgcagtatgctagttattgctattttgggaggtatttttacattagactttcaacctttctacacatattgtcatggatcgtgtgattttactcaattattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatattggatctacttggcaatttaaagaatgttaattaggaaatttaaaaaaattcagaactataaagaggtactcacgtagttttggaaagtgtgtcatttatgggcacaaataaaaaagatgtgtaggtagctgcatcctgtacagcaaaggaagttttaaatatatccagcaattttgttgtcctagttggcgcatggtagctatcaggaggtaactcaactccatatagtcaaggaaacgctatagttgctccctaaagtgatgtgtttccatgtcactatggaacacttgaaaccgcacacatatgaacattagggtgggcatatcttgtacagtagaataaggaagaggtttgcatcagaatcccccttttaaaaaaatgcagattttcactatgactgcaataaaattcctaaagattttgtggagtaattaagttgaaaatccatgaaagttcttctcattaacatagttataaatatgataacgtaagtaaaaattaagttaatttgagccactcagagttactttgaaagacagatttaaagtgtcaataaaatgataatttaaatttcttgttaacctaaaaaagaagtaccatcatttttatttatgccaataaattgaaatataatgtcattttctcactaacgtttaaaggaaatgaaagctctaaataatcaagtgaaaccaagagcaacttgtctgacagctattagcaaaaataaataagagtattcaccttcatgaatcaaggcaagggcacgaataatttcatggtgcagaagctctaatgagcccacccactctatgtgccccgagctgtaaggtcactaaactaattttaaaaaggtaccattaaggcaggtagaagcttacaagactcatttaactgtatgataaaagagatatgaaagggacctattgaattaatcaggtggaacattaaaaagcttatatggtaatttaaccttgataaaaatacatgggagaaatacaaaggaatttggaaaattctctttccttgaataaggcatcagttagctattcaggttattaggttgaaggaatgttaggagctcttttaaaggtgataaagtcaagataatgttgcagattttattcttacgtaacaaaccccctcaaaacttggaggcttaaaatgtgaacaatttatcatttctcattgttctgtggcttgactgggctcagctgcgtggttctgctccacatggtattcgcaagggtcattcacttggcttcattcagtaaactgagctggaaagtgcaagaaaggtacgtgcacgtttttggagtattggtgcttctccatgtggcctatcgtatggctaggttgggcttcctcgtggcgtggtgattacagagtaattggacatctttcatggtggctggttaccaagagaaatgaagcagaatttttctgtcctcttaaaggctaggccgaggactggcaaaagtattaattctgctacattctagtaaccagagtaaccacaaacctacctcagaataaaggggaagggaaatagactccatatgaatagcacctgtgtatagcgatagaaatgatgtgtccatctttggaaacttctgctgcaagtagtggtagcatgctatagatccactaggaaaatcaagcacaaactctttaaaaaataaatgtatcttagtaaaataaattagaataactagataataatggctaacacacatgaggttaatatgtgcttttcaaagattatctcatgtaattctcacagcaacacttccaaatggtattttattaacccctgtgatacagatgaagaaactgattgacagagaggttgaataatttacccaatggtacacattcaggaagaggtagagttagaatttcaaaccaagtcgtttgactccagggcctatgagttacgttcatagggctaatattcaaatgagagaaaagaagtaataaataaacatataatatgttgagtgggtgctacgaagaaaatatgaagtgtagttggagatgagttgtcaaaaaaaggtcttagcacttaaaaaacactgaaagcaaacaattctctttaccacctgaattgtaacagcaatctggaattgctataaagtacacaacatgggagaagtcttaaacaacagtttttattatttataggcccattgcacgctgtcattaaataccaatatgtacaatcaatcatgcattcattgatttaataaatactgtgcaaacaaaatagaaatacagagatgggtaagacaagtccttgggcctaaggactttataacctggtatttcacccaactacatgatagcataaataatgtttgcttctgtttaagtattccttgaacattatagatctaccaaagaaaattaaatacaaacctctttttaaagtgaatttgaaaagcaaaataaattggaatatatacataaatatgctaaaatttgtcatatgtactttgtgggctttgcatgtgttatttcattctcagggcaatctaagacgattacttttactgtctcattttacagagaagaaagctgtgcattaaagaaatcaaatacctttcccagggtcacacagctagtagcagagcctggatttgaatctgggttctgatttttaactgccatgacaatgatcaaagctcaaagtatgatctctgtgttagagttatcagggttgctcgctaaaaaagccgattctcaaacctcatcccagacctactgacccagacactgcaagtagaatccatcaaaatgcagtagttactctgagaatcatgaaactctactacaccgtctgtcttcctattcatggaaaccctctcctagtatataaatgtgaagaatatttctatttcaaacctgtattgataattctctggaagatcattttcctgggaacatattattgatgagactgcaaaacagaagtaaggtattggattgattttttcactgaagctagggaaatattgatgttcattggttccagagaagttcaatgatttccaatctgaattaactcctttaacaaatttttttttttttttttttttttttttttttttttttgagagtgaatgtccctctgggcttctaggccacatagttgcttagagaaattaggtactttgttgcacttgaaaacattaaaatctttctgactactttcactgagcaaagagacctaaaatgctttaaatttgcaacctttcagaaaataaattctagtgattatttatgactcaatctttcagattttgacagtgaaagtggaaggttgtccaaaacaccctaagggaattatttcacgtagagatgtggaaaaatttctttcgaagaaaaggagatttccaaagaactacatgtcacagtattttaagctcctagaaaaattccagattgctttgccaataggagaagaatatttgctggttccaagcaggtaaaaaaaaccttaaaaaataattactacatggaaattcactatctattcttttaattgtcaaagtaactgtagtctataatagatgtattaaataaataaataaatatattttgcttccagtgtaaacttcctgctgacatatttattttggaatgaaacattgcatctgacactttaaagatatagtaaaacttattttatatatatagttactagttgacttatcactgtttaaattatttaagaaaggtaaatattagagataagtgtgtgtgtgtgtatgtgtgggtgtgtgcatccctgtttatgtacgtgtgtgttcttagacaacactgagagagtttattaagcaagttctgagaagatagtgagttttcaacagaattttaaaagcatttatgacatcatagtggatgcctaagttttagcctatactttggctgtcctactgctttataagcaagtgggaaatgttataaagtaatatgatgttgaaatgtgcaaattacattgatggatgcagccaattgtaaaaataaatatacactttttttctaggacatgtatttttcaggatttatgtaagattacatttgtctattcataactaattataataatttatgtattagtgcacagggattaccaaaaatatttcatgcatctatatctgagcatgcatttgaattgattaatgacctctgaatttttggggtaggaaaaacatgtgaaacaatgttacaaaaagactacagttgcttggagtggttaccttcattgattttaagcagtaaaatcatttgctcaacatttttgggtatgctgtgaggctgtataaccatagtgtccttttgcctttagtttgtctgaccacaggcctgtgatagagcttccccattgtgagaactctgaaattatcatccgactatatgaaatgccttattttccaatgggattttggtcgaggttaatcaatcgattacttgagatttcaccttacatgctttcagggagaggtgagtgtttaatgaagacttaatatttagagaaattagggagatggcatatgaaaagtaatatgccattttctcagagtttacttgtttggaaggcagctgaagaattagaaaataagctcataaaaccttggagtaggcaatgtaaagatacacaagcacatataacctcatccaatttgtcaggaagaaaactccttaggtgctcactcagctcttggccgtgattacattgtagggagtgtgattatctcttttctgttgcacagccactaagccatttacaaagaaaagagcaaatccagtgtttataatgctaactctttcttctaaaataaatagagacattttggtactgcaaagggaaaataccattttggggattaaaattagctttacacaggtgttacaggtttccaaaataaaccttatcttgattggaattaatcaacatataggtagttacattgcattaaaaagttcagaaagttttgggtttagcacaatcaatttctttttgaaaattatgaggattgatttgtgattctctttcgtcatcggttgagcctatttaaactgcttaacagcatcaacctgaaatggatcttaatctacaggggatttaactggttttattataaagttatggataaaatatttaatagatatggatgaggactcatatcgttaacaacccaatactttctttcaaaatgagtagatctgtattacaatcccttgtggtgtgtgcagtagattttttccctttaatttaggaagcagttaataaacagctccatttggatccatttaaatttcttttagaacgagcacttcgcccaaacagaatgtattggcgacaaggcatctacttaaattggtctcctgaagcttattgtctggtaggatctgaagtcttagacaatcacccagagagtttcttaaaaattacagttccttcttgtagaaaaggtaaggaaatcaatttaaatgcttcaattgtaacactaaagaaatctaaacttaaaaacatatatgtatataaacaaaaaacctttactttaaagctttgtgacagtatgaggtttagacaagacgttgagctctgttttcaatcatgtaggctgtattcttttgggccaagttgtggaccacattgattctctcatggaggaatggtttcctgggttgctggagattgatatttgtggtgaaggagaaactctgttgaagaaatgggcattatatagttttaatgatggtgaagagcatcaaaaaatcttacttgatgacttgatgaagaaagcagaggaaggtgtgttttgaaacaacttacaaatgcgtttaagtgatccttcaatacttacaaaatgacttttattaaatgtaaatattcttattcataacggatgagttgaaaaatagtatattcaattatagggactgttcagaaaactggattatatttattatcaataaaatcttgtattctagattcagaaaatgtttttgagggtttgaatgctggctcattgaacaacatatcctcatctgtgaaacaggaataccaaccacatctatctcatagaattgttataaagattcaaatggacaatacatggatgtaatttactaacaggtctgccatataataacagcttcagcttcatgaatgtggcaaaagcagagaataaataactttctagtcagatgtctggtagtctgcagcagttcagaattctacaagtgaacgtaggaataaatttttgaaattccaagtagatagatattaagtgaatctttaaaatgttctcaaattttctagagaaatctaggattggttagaaagggaggggttagaaattatagaaaatattccattattttttcatatcaaaaccacagatttatgtatctccttaaatgttgtttttatttaaaaaatgttttattacttttcaggagatctcttagtaaatccagatcaaccaaggctcaccattccaatatctcagattgcccctgacttgattttggctgacctgcctagaaatattatgttgaataatgatgagctggaatttgaacaagctccagagtttctcctaggtaattctttttgttaatttgagaataaaaattaggatgtatttttctccttataatttagaaaatagatctcataattatattgtcatagatttttactgtcttcatatatttgttataatgttttttatttggaatgatatattttaaaggaatatcatgttacacatctggaatttgctttgcatataatcatgtagactaggatcaagatgaggatgagattatcatggaagcacaaatatttatgaaatatatctttgtatttgccttaattgccagggatgtgggaggcaaataagaaggttttcaggtgagttaagtgaagcagccatattttatatttaaaatgacagaataggtaaaggaagcacacctcagtgtagtcatagcaggggttttatgactgagtgtgacaatgctgaattctcatagaaatattcataaaaagccttgaaattaagaagtcagaagtgtcacatggtgatatactcaaattctttttttttttttttttttggtatgctgaacaatttacatttgttggttccatgaattcaatcagttattttcaatagaggatgatggaaatcattgaattcatgtagcatgtttaggtgttcattgagaaaaggtgaagtcatggtaaccatgttccaatattctcgtttgtatcttgacttcctggacctgtcctatcattgtacatggatttttaggcctaaaagatgtttttaaaaaatgctcatacacttcagaagatgaaaaatgtatgcattataactactttgggaaagaagcagtcaacataagatatgtcactgtatgtcattcagtagattacatgtgtggcttctcatgtctctcagaataaaagctaatgtctttacaaggcctgtgatgccatgatctatctgactcctcggttattgtttgtttgtttgtttttaatatattttatacaaatttatttttttaattgacaagtaaaaattgtatatatttatggtgtacaacatgatgttttgatatatgtatatgttgtggaatggagaagtttagctatttaacatatacattatctcaaatacatatttttgtggtgagaagttttaaaatctactctaatagcaatttacaagtatacagtatgttattattaacagtaggctgatgtactcaagttttaaacattccagagagtcattgaggcaactacgaaatgcattagactgatttaatgtaaagcatttaaagacaattttgaccttactttgtttagtttttgttgttgtttagtttaattttaatcaaattaccccagagataatgcctaaaatctatcagtcaggacataatattcttagcaaaaaactgtccaaaatttgggacatgatatttaaagctaaataaacacctttatacttttcatactggcattcattgggaagtttaggatgaatttaaatgctttggaactgaggaagttaatgtattagtaatagaggattaacacaaaatgctgaatcgtcaatgctgaatcctacattttaatcaaccccaaacttcaaggtatacaggaaagtaccagacatagtgcatccttcctctgaagaaatcccaaactgtcagacacagattcctaaaatatttctttgtcctgcattaaaatgtgtttcagatgaatggacacgttttgagtagtgtatgtggaaacgtcatttacaaagtccgtttagttggccgggcttagtagcttactcctgtaatcccagcactttgggagaccaaggcaggtggatcatgaagtcaggagttcaagaccaacctgaccaagatggtgaaacctcgtctctactaaaaatacaaaaaaaaattaggcgggtgtggtggcgggtgcctgtactctcagctgcttgggaggctgaggcagataattgcttgaacctgggaggtgaaggttgcggtgagccgagattgtgccactgcactccagcctaggcgacagagtgagactccgtctcaaaaaacaaaaacaaaaacaaaacagaaacaaataaacaaagtctgtttagttacacagataagaaaatgtttgtgattactctcccttctctagacctatgtcccataaatccataaatcccatgttcacttacagaaagcagtctagataggagtttctcagtctttgagctgttgccattttggctgggatgactgttatcgaggtgcatcgtaggatgtttggcagcatctctggcctctacccactagatgtcagtagtatctccccttcttccctcaggtgtgacaatcaaaatgtctccggatgttgccaaagataaggggcggggttgagtatccgtgatttaacaaattaggtgtatccttctaaaaacattttacaggtagagactccagcatctttatattagggtaatctggagaaggtcttgcctctctccgttttccctcttcccatttttattgtagggcagcagtgcattcaggctttttgaaaactctctttttcccagatagcagtaactattatgcagtgactaatacgacccaccttaatagatatgaatagacttgttttgtgaatatattttaaaatataaatgtatgggattttgttcatgcatctaagaagctacaaggtacatttcctcttggtggagctatttatttttctggagagccaagacaggtacttctacttctgtggtgtaatttgaggggttaggaaaatttccttgccttcaattttccttccaacctggatatcacaaatacacaatagtagtcctcaactttatttttgttctcagtcacctgaaagacatgacaatccatactctatattaatgcagcagtgattctcaaatagagaagggctttaaaaattagaaatccctactccatcttgaaattttgatgtatctccctagagtatgttacttctctatgctccattacaatttctctttattgttgatagctgtccagattgaggggaagcagagcaagatgcatctattatatgtttccatctctccgacccattctctccctttcccctctacttgctttctttctcttttccctcttctgtttacccgattctatttctgattccaatatataacagtttcccctgaaactctctcaataccaacaatcctaactaatggtttttaaaagtcaaatacttattaagtactggagggatagaatgagagaataccaagactgataagatgcaaataatacttttaacatatttacaatctagtagaaagacatgctcaaatgagttaattattttaatatactctgtctctgagcataaaatataattatatatgctcattatagatgtataaaaaataaacaaataggtagaagctttccatagatgtgtaatttcaccacttggaaattacaagttgttatagactgttttgcgtgtattcacttatatccatcaagtgactacatttcaaggcactacatgagaaccataaatattgtacaaacaggatttgctgaatgtcgttggagagtaacagtccatggggctgattgtgatcagtttctgaggcaggcctctatttctgggtatgtattggtccctgtaggcttgataaactccctggaggtggagatgatggagtagcagagctcatcaagggtatggaggcttgaaggtacaaagcatgctcaggaaattttggctattccggtttgtctagagcacttgttctcaaccttacctgctcgttactaattctactaaatatagaattaaaagaagaaaaaatctgataactattttctcctgggactaattagatcaaaatctttgaacccagacattagtgttttaaaaagctcctcagatgtattgttcagccaggactggggcagggaaagctactgaactcatcaagccttgagaatgagaagaacaagaagagaactttaaaaggatttaggggccacaatatgactatggagctgaatttagatttggtttcgtaggcaacatggaataatttgtgtgtgagcaggagaatgacacaatcaaagtggaatgataggaaaagtaattttacgagagagagagaatgagttggaagtaaggaactcaggaggcctcttgggactcagcagaaggctctgaggccaccaaatgggtgtggtggtagtggaaatggagaggaagagaatgtgaatgaggctgcacagtgaactgccagtgttagccgtggggttagaccggagcaagacttaaaatggttcgtcagttttaactccagaaagacctcaaaaagagcttttgtcttgttatcatcagctatatggaaggtagaataaaaacttgttaggagaaaagataataaatgtggcttttgataggctgtgattgagttggaagggcataccagtgaaatatccaacacaaagttagaagtgtagaagagcacttaggaggtggctataagtgaaaatgtgaaaattatctacgttagagggatagatgaagtcacagaagtggatgacataattgagcaggttatatgtagaggaaagatgggaaggttgaggacaaaatctttagatggatctttctcggagtagaaggaagaggaaatgttaaaggagatttgattcaatgaaacaagtagatcagatttctattcaaatatacaacagatataattaaaacagatataatttatttagttttttttttttttttttgcttggacagattaatttaagtgctttgtattttattttcaacaggtgatggcagttttggatcagtttatcgagcagcctatgaaggagaagaagtggctgtgaagatttttaataaacacacatcacttaggctgttaagacaagtaagaaattcagtaatataattatattaaattacacattattaatctgctggaattcttattttgcatacagttgtgaaaatgcaaaataatgaccacatttctacttgagtttaattatgcaattctagtttgtcttttctttgtagaatagaaagttttgtgttatttctcctgttgagaaacaaagcactatgttctgagaatccttataattgtgatgcatagtatgttgtaaaaacttttgtaagactcacttaccctcctctttttactttagaaccttactgttcaaaatgtgttccatggataagtagccaggcattatccaggagattgttagaaatgtagaaacttgggatttttcagcgccatgtttttgtccccggtgctccacagtagtcagactcctagctgcctccacttgcttccagaccttgaagcctagcaagctcctgacttcaccttctattttcttcagagtgtttatcttttacatttctggtctagggagagtatgatttttatttttattgaacatgacttccgtgtgttcagagtgaaagaagaagtttaatgcatgacctcacattgctaatttgattgaaggtgagaaatcttaaaccaaaactctcactgataagcttgcacctttcttttctggatttatccacttcaataagaaccgctattgattacttgctacaaagatggaaaagtcagcacgcttatcctatttcctacttcctgtccctgcccacttcctaaaatttaaaattggttaaattagttttcctcatgtataacaattataacttggaatgatttacaacacttttgattttttagtacaccaattctagacagcatggactgactccttgctatgtgagatgaggaaaattactgccattctttctcctcttcccatcaccttctcacgttccctaatttgttctattatttttatgtagtgaaagtttatcacgtctatattctgttctgtgctcataattaaattgttcacattttgtctatagtttggttctgaggacaaaaccaataaatgccatttatatatatttttatttgtacagaaccaaaatatttctacttttagacaaagaaatgcaaccttctgtcactaacttcttttcctaatagaatagtaacagtccaaataacaaagtcaaacggatcctctattgttatgtatttatcatcagtctataaaaataagggcatattttaattcaggccacatttttaccctgatttaaaaaaaattgtttttagagatgcagtctcactaggttgaccaggctggtctggaactcctggcctcaagtgatcctcccaccttaaccttctgagtaccagtggtgatttattttatgtagctttttgaggttttctgattttatatatatatatattttaaaaaacatacttcaggaaaagatattttcatcatgtcttcaagtgtttctaagttcttaatcatacagtttgtataacagaatctactttcttcttgaagacattcatcattcagcacatgacttactgctctaaacaggagagatggatttctaggctgcttgcgcactgattaatctatgagttagtttccttgccctctttgattattctcaatgtttcttggattccatgccttctcttggttgaattgtccttagtttttgttgaagaatatctttgaataattttttttaagaaaaggtgtttgtaaggtaaatgttttcagtccttacatgttaaaaatatcttaattttgcctcccatgtggtggatatgttatcacactttatattttaggaatctaggtttgaaataatttttcttcaaaatttgaagaaaattccgctgatttttagtgcccactgttgctaatgagaagtctgcagtcagtcatgtttgctcctatctaagctacctttaatttcattttaaaaactgaaaatttgatcttttgaatttcatttgttttcattgttctgaaccttcacaagtatatgtttgtgtgtaggttgtttttcattccatctaattcatttttttgtgaaaaattatcttctgtgtattctcttctattatttattatttcctccctaacctttattaatcatttttattgacagctactatgtaccaggttaggtgataggatacataatatacatatagtactaagctaaacccagtcaagcctctccttctctggagcctatatctagttacttatgattcattattgcttgccattgctccaagagtatgtattagatgacaagccttctgggtctatctcatccatgtttgagttccctcttcaagttttatctataatttgtgttacttacttgactatctcttgcaggtttctagtttgtttttcagaattgcctcatctattatttagttttctgctgaattttgttttgataatcatatctttcacttccagcaattctttccatcgcctctccttgttcttttgtagccatatttttggatgaaataccctcaagtgtttctgttcacatcaattggaatttaattttttgtattacttgcattattgctgttttctctgaggtcatttgctctatgggttcaccttgatttttctcttttatattgttggttttccaaattgagtagttttggatgacttcatatctatgaagtgagtactatattgattatcaaagataactagaatgggcattcttcacatttatgtaggtttgcttgttcaagttaccactttctgaacaagaaggtagaccatagacttttaagggctgtgtactgcttagggatactctgtttttaggttacatgggcagggatcaccaggactgctgagaccatacctagcaaaggaaggcaggctaacgatagttgatgagctaaaaaaaaaaaaaaagaaaaaaagtaaacaaaaaaatctcataatgttttaagaaagtttatgaatttgtgttgggccacattcaaaggcatcctgggccacatgtggcctgcgggccacgagttggacaagcttgttgtagatacttcagactctgttctacatctcttcatagatcgataacttgctgcaatgagcttatcagagaaattatcttcttttcatccataaaaaaagtcatgggaggtactcactataggattggtttattccagtgactctggccaattttctttaaaattcctttaaccttgttatattggtttaatttcttcagaatgacttttcccattgtggtaaactggttctaggcttcacaattacttattccaagtacaggagaaaagagggcacctcttttgaggacttgcatttcaaaggaatcaaatggcctacataacaacccattaaataaataaatgtctctcagcaccagttgagtcacctgtgcttttctcaacaagcactatgttcagggcaatgctctgtgctaattggctttaggtctctgttaccgaactgatcactgtggccctgagggtgctattacttagaatattctcaccttttctgagaggctgatgttggggtcagttccacctgaactaaagtccatgggctgcatgggtaaaggttgagtacctcagcaaatatcatggaaaggaaggggaatatacactgttagttaacagtggttactcctgtactctctcttgtttggatactactgggtatttatttctttttctgagtctttattgacattaggaatgagagatagaaatagggtgagagaggaagtaaaatcaatgctaatttttccatcttataccagaactcaactgtatttctggaatctatgtatccttacttttcctttgatttattacaaaaaaattcttagtggctacactaaaaattttgtaacctttaaaaaatacatagttacactacttcagttactctgagtaatagaaaatttcatgtgtgtacaaaatatcctgggggcattttaattattagtaactacagtcacagtgtagttctagaaccaaattaaacattttgcatatagaagcttatctgtgaaacaaatctggcacaatctcttttaatgtgtaggtaatttgttatataaattgattttttagctttgtttgttacttgtcagcatgcatttcaaattttacacaatgtgtttggggaactctgatggaagtcagtgcattaaaaatgtctacagggccaattagtgtataggcagggaggcaaactaagggaatggtggaagaaattggaaaaaaaaaaaaataaccgatgtgcataatgtactacttctcgtaaaaaaaaagaaaaaaagacaacaacataaagaaataaaaatgacatttgatggtcattctgccagtagtcatggggcagatctatgttacactgtactattatgctcttttttccttgcaatcagtgagttgcttttccaggatagaaaatttggattaggcctctgtctgtgcctgtgaaaataagtagagctaacttaactcgttctcatcagttttaaccaactgagctaatcagacatgggcattaaaaaaagattttatctactaagcaaatatgatcacagtctgaaactttgttcttggaaaatcccctctcagggtgttcagcctttcttcttcagtttgcagaattctccacgtttcagtttcctgataaatcagtgggtgctgctactccacgtctttgaagctggttgttaagaagcagcacttctacagcgatcacagtttaaagcatgaatcaatttaacatcacataagctataaatttcaacggagttacagtttcagagtaaagtgcaatatacagtataaagtgaatctggaattcaagcccaacaatgtcataaaagaggctgtgaagtctcacatgatgtgggccacagagaggattgttgccattcagatcttagctcaaatactaccacatctcttggagtggcccgccaggggccacccttactaagccaatccctctgttcaagccaaaatgatatctcagactttttttgaattgcagagagattgttgcagccagggattgcattagtaagggtggcccatggtgggccactccgaaggatgtagtaatatttgagctaagatctgaatgccaagaagacttcagccatgtgaagggtggagggatttctggggagaggggtcagcacaggcgaagaccctctgacgggaagaagctgagcacagcttgggattgaatgaatgccagtgtggctgaagggtggtgaatgaaggggaggggaaaaggagaaggtctgggaggcctgggcatgatcagatcaggcggtgaggccatggaggtagatgggattttcatctaagaaaaataagaagtcttcagagagttttcaggaggggatgatatatatttctttgaagttgagcgttatcctcggtaaattttgtagtcattaaaccagagattatagacagattttccctcatatgccagttgcagctgattagtagtggctatagagaatactgggctgagaaggattctgtggctaaccagaattcagtagacgagtttgacatggcccattagtatgactgtactgtgtgcactgtttctgcattaaatgtctgacaaaagcagagccaaaggaaaaatagaacttaacaatttaattctgacaatacagttgacccttgaaatacataaaggttggggtgctgaccccttgtgcagtcaaaaatttgcatataacttttgacctccccaaaatctgaaccactgatagcccgctgttgactggaagctttgctgataacacaaacacttgattaacacatgttttggatgttatctgtattatatactccattcttaccataaagcaagctagagaaaagaatattttatttaaaaaatcataaggaagagaaatatatttactcttcattaagtagaagtgtgttattataaaggtcttcatcctcatcatcttcacattgagtgggctgaggcgggggacatagaggaaaggtgggtcttggtgtctcaagagtggcagaggtggaagaaaatttatgtatatgtggactcagacacttcaaacctatgttgtccaagggtcaactgtagtttcaaaaccagctttttatttctgaaaatatgtttaaaaaactcagagaagaaatggaaagtttgctatgatccagtcatccagagaaatccatggtcaccctgttgatgcactttaaagaaggagaaacgtgggtaagacctgatggtgaattactcttatatgattttggacttttgcaggagctggtggtgctttgccacctccaccaccccagtttgatatctttgctggcagctggtattcgtccccggatgttggtgatggagttagcctccaagggttccttggatcgcctgcttcagcaggacaaagccagcctcactagaaccctacagcacaggattgcactccatgtggctgatggtttgaggtaagcaggtcttgttgtttaatattcagtgcatgacaagtgtgaccccagacttactctcaggttccgagaacacttcccagtaacaccgtgccccagtaacaatttacaaacaatttggatgaaaactaccatttccctgatcaaatttggttaatttcagaaaataagagtatgaaaaccatgtagaacctcatagcaagtagtaatagactttgaacccacaagttcagctgtggaacccataattttaaccctgtactgatctgccttctgtacaaatgtataagttaggcttcacagtatcaaattgagtgtcaattacatgattccagtgaggaaagatgagtccatacttctcaaggggactagagtgattcacgttggattcttcggtatgaccatctcacatgtctcagaggtacacctatccacgcagccagagcaagctttggagagggagcacactggagtggaaagcctgttgtctttgaaggcaaaacgcctgggattaatcactgttccacacacttagtaactgtgattttatatctctgattcccattttttaaatagtgtgtgaaccatgacttatatttaatgcataaaattgtgatgacctctgtaataatggaagacattccagatgaaactcttgatgtccgctctgccattgctccccaaccccagtcacctctttacacctgagagtcacctttcattcttttctttctctctcatctcatagctaatcctttagcaaatctttcagctctgccagcaaaatatatcttaatgcttctaacaatttctctcactaatgtctgagccagtatcatctctcattgcctttcggtcccctgcttctatctctgtctcatgatacatcccgttcttcacacagctactggggtgatttttctaacatgaaagttggatcaggccttgttcctgttatcaaccctcccctgccttatttcttgggcagggtgctcagccactcctatccctgaggttccttgcagataccagaggctttatattggctattgatttcactcaggagtgtctgactcccagatatgttctctacttattataaaggattatttgaatcctttcattcaggactctcagcacagaggatgtccccgacgaccctttgtctctccagcctctataggagtattcctgcctaggattttttatgttttcattttttaaaaatttatttattgtctgtcttgccatcagaatctaagtaccattaaaggagggacttttcatcctattcaccattgtatctctagctcctaaaatagtaagccttcagaattattgtgttgacagtaggggaagagggagaaaggaggaaagaaggaaaacagtgcctggtgcatagtagcaaagcagtgtatgtaactttccttctcttctgaaatgctatgaatatgccttttaggtagtatccagaaatgtcccttcctgaaagggtccagaaactactgaaaactgtccagattatgaaatgaaacagggtgcagggatttgcatttgagttgatatttctgcttttgaacaccagggggaaccttgggttaaattaatgtaggtaaagtgcagcttagtctcctgtatttcaatgccctctttccttcatttaactaactctaggttcagtttttccctaattcttccacaaatccgcaaagtgtttatttataaagtgaagaattgctattttttttttttttttttgcttaacactgttcgaaacaccttgtctctaaaatgacttattctagttctgtgaaaccttactttaaacaacaaatccagcagtttctgatgaagtaaatgaaatgtcagcatatttaaaataatttgcctaatttgttcttagcttaatgccagaaaagatttctggattttgtatcacaaaaggctagtagatttcagtatctatcaatcttctaccagcactaagtaatttttaaaactcagcattaaggtttattttcccaagtatgttttagcacagaaaataaaatcatgctcctttggagtcccttgaacgctggagctgtttagagtgacatacaagaactttcttcactttacatgctctccctccatcttgcttttacctgttagcttacctctccaatccaatccacttcctttgaacgctttatcataattctataaaacttaagaaaatataatcacctgcattttctatatgtttctgtgtttcagtatcttcaaaatggaatgtactgccttggtacatcacccactataaatctattatttctgctatatcccacacttgccaggccaggatacttgttgcctcatccaggccaaacaccattcccaaaaagcaactatgcatttgtccaccaggtccttgactctattttacattatctttttagtcaattcatttacttttatgctgcttactgctgccttggttcagcatgtccagggaattatcagaatttcttttctaaaataaaaatcaatttatgcttgcaattccgtggcagttctcaattatctgcaaagtgcatccaaactcttggcatagcatcaaagctctttctgtatgcctcttgcttccctttacagcccctgccaccctactgcccacactgcattctagccatgatgacagtcttgaattttcagttatgctcatgtctctccgtcattgtatttgttattcctctctttccaccaagttgtctgcctagaaaactcatttttcttaagaatttcctcacatatcatctctactgtgaagctcaaatgtgtcatgaagtgttagcttctccaacttgtgtttcttgcacatgctctgtgtaagacattgtcttaggtgctaaagagagaaagctagatattatattgttcttgaggttgaaagcttacagtctagtgggagactcaactttgctgtctttacctcaatgtttttcttcctctgtgcttccctagcatgtggtagttacatatttctggaaccttgtttgaacacctgtttgaggactgtttgagcacaatccttctggattgtgacaccctcaagagagcagatatacaaagatggctttgtatactaaatgactggccctcatagatacctagtacatatttgtcaaatgaatgaatgcattctatttttggaataattctattcagaatgagataaagtttactttaagctatgaagaaagaagtttcttagcaactcttaaaataatcacaaagaatgactgtttaacttaatataaaccagtttgttttaataaaatatttgacaatagtcatggttacacaatgcataaattatgactaaattattgtcaggaaggaaagatctttacttattatttcaaaagctattttgctagtctattaaaagctattaaaactgcacttcttaagattaaattctataattgaacattttaactaaccaagatattatctctttcccactgacattatttcaaattaagcttaactattcctttttagcctttggaaagtattctgagtctgtgttctataaatatacttagagaggcatgtcttataaaggatttggatactgttcagtgatgtatgacttggctttagtttttctattcttaatctctcagcttttctcttcagcatggcaagagtacctaatggcctttcagtaagcccttagtaaatttttctttcaagcccattacttactgtgaaggtcaacttcattagtgtatttatcttatttttttcagcccaaaataggtatattgaaatgaatgggcctaatgtcaaatgtcccaactacatcctggaagagagagaatcttctgctgtattagttgatgcaattaaataatatgtactctccaggccatcatacaattcaaagttcagggtatcattgccgttctcttctaatccttccagaagtgattggtactaggtaatggagtaactattaattgatataatgtgagccaaaactaacagtcacgaataagcaaagaatttaaatttaactccattaagtcttgtgaaaaattattttcaacctaggttgtcacatagctgtgacatcacatcaaatgctgtagtcaatttgacatcatggggcagagaagacagagttggaaatcagaattttatagacatataatgtgataatagcattagtagctgagacacggtaagctcactgaccatgtttccagaatggataagacctggttgagatgaaaactttatgttttttttttatattaactagcttttactctttgcctgaaatgttcaactctagttgctcatgattgcgtgggttagtctccaaaaggatggaatttaatgttacccatcatcttttccaagacaatgttttattcattctaactcagcccaaaatactcttttttaaccttaatatctaacatgattaggtttatggtaaattatatactcaaacagaagaagagactaatagcaagcaaaagtcttatattttcatttgttttcatccaaaaagtagaaaatattttccaaacattgggaaacattttagtcagaaaaataaatatcaatggtaaataggatagagaaaaattttaaatctgagctaaacctctatatggttttaagaaaatcaaaactattaaataaatggcaagtacaacaaaatcccatcaattcttatttaacttatttgaaatagctaaaatattcacatgatcattgagggtattcagaattgcctttaagtaattgttcatatatactaaagaaaagtctccaaaaattcggtctttgcctgagatagatttgtcttaaaattgaaatcattcgcttatcagatttgaccgttttttaaagcgtaactttactttgtaatattagacttgtatgttttgattttcttctataataccacttaactttaagggtcaaagtgagcacagaatttttgatgcttggcataatggacatgtatatttaaggaaattaggagagaaattattataatgtaatcacatttgaataagatttcctgtgcattttctggcagatacctccattcagccatgattatataccgagacttgaagccccacaatgtgctgcttttcacactgtatcccaatgctgccatcattgcaaagattgctgactacggcattgctcagtactgctgtagaatggggataaaaacgtcagagggcacaccaggtaggtgatcaggtttgtctcataattctgtcttcaggatggataaccactgacctcagatgtgagttcagaagagtcaaaaggaaaccagagtctatcacattgcgaacagaggtttactgtgtgaaaaattgcaagcattacattgtgatttttatcattgtattttgtaggaaaaaagacaattgaggtaatttttcagggcaaaaactgaataaaaaagaagagaacatttgatatcaagttatatttttataagttagatttttagattctttagatactctagaggttgtaaaaagtaacagcaaaaacttcagtctaggtactgttgacacttgtgaggcaaatcaaattcaggtccacagattctttttcataactctgaaatccacaaattctttttcataactctgaaaaccccaagttttttttttttaataactaatttggtgtcaaaacctaagcaaactgacttgatgcttattacagtctttatttctcatgcccagtgtgaatatgcgtacattttgctgcagaaatatatacatgtttgagtacagggggccggccctgacccttgaaagggtttctgtgcacatcactaactaccccatggaatattccctccctttctcagttcccactccacttcttcaactcaaattcatcagaatttcaagctcagattcctaaaaagcagttatggggccagtgatctgtacagacatgttgtctcagacatcagtttgagcaggaaatacaacatttaggggttggcatttgtttggagggggggatcactctatctttagggaaactttatatagttagttatttgtaagtaaaattacaggtggctatacgtcatcttgatgattgcaactcaattaaatcaccatgcctgacacagaagaaaatatgctagaggatatctcactagggaaaaggttccagttcaattcttgcccactcaacttttgtatttagataaacaaatggctccagattccaatgcctggttttatttttgctccaaatacatatatactcttttgttttgcataggtacattttagaagtagactgtgtattctcataaacacttcaaagtgtatgttctggctgagagtgtctttgtgtagttcaatgaaattaattataatttttttcagtaccgtgctgtgcgtcaggcccagtgccaggtatattagagacaagatctcttatcctcatgccagggctgaaagttagctattattttctcatttgccaaatgagaaaactgaggctcagggagattatataacttgcagaatatcactcagtaattggccgagataagaattcggtctgaatgagaaccagatccagagatatttggctttaaattctatagtctcttctaaaccatatgtgactctaacatgaagaagcttatttaattttccctattaaaaaagtcaaaacaaaacaatagagccatgaatagcaaatattgtcaatgagaggtttggaaaaacaatcttaaaagatgaaattccatagacctcatatattcctacctgaaaaaagtgggcacaggacaatgattttcttttggaagatctgctcatttttgtcatgggacatgaaggtggactggaccactcagtttcttctttctgcatctcccaacccagtctttctgttcatggggtgaaaatctgttgttgaagccttgtctacttaattggacagtggaactctcgggtctctatgggctgtgttcttgtacttgggctctgcttctctgctctgtggtctgggtcagctagcagccactcagttcaccttggttcagactcatggcctttcattttcagtatctgatttctggttttgctcaatacctgtctaaaatgtaatacccatctgattcttcataccaagcgacacaattgctcctgatcccttttaatctccaatattgaatggtggtaacataaatatggagacagatcatgacagaaacccagggcctaatcttttgtgcccactcttctcacaggcttcttaatactttggaagcttttttttttttttttttttttttttttttttttttttcgggctgtaacctagattttccctttatcattactctattattgttagagcacttctaattatcttagccctaaactctgcctccaattttaaataacaataattctcactcctactaatactgctactagtactactgtcaccaaactttttcttccccaaagcagttctgtttgggaagaaaacagttccctctcatacaatttcagttatcttcttgtcttttctgtttcatgaatcttcctgttaatgttacatcttttaacatggaaacttctagagaaacaaaagacgatggatttgttaaactttttgggtgcagttttatacgaactcttaccgaagtgtgtgcattatgagtgtgggtccattacagctgtaataggagcagaaccttccagagcatgagcgatgtgctgggcttgtgcttagctctgtccatgagttgagcatctcaatccttaggaccctctgatatatgtgctattactatttctagtctatagatgcagagactaaagtttagagagtatcaaaaacatttacaaggtcctataggacaaaactgtaagacaaaatgcatacccaagcagcttgagagcagagctcctgtccagcactgtgatagctggggacgcagaaacggaaacaatgcaattattgacaagggccgtggtgccatgtctgtccatattttgaaaataattatggtatggatattttcacctttaaataacttggagagtttcaacattaactcagtcaaatggatatatttatatcatatctggttgggagtgacagttaattctgggtcctgtggcaattgcacttttaactgagatgaatgctgactgatggctttaacatttaactaatgtgatattatttaacacacccacataaatactacagtctttgggtaaataaaatgttactggctggacatacacgaatatctgatggagattatggaacatactctactcatatttctctgaaagtaaaaaataaagtatatgtttcagtacacaatgtgatatatactcagacttaattcataaatttctcttattcttcatctatggatcctttatttatttacttattgcatttgttaaaatacaagcttctctgaaaaattatttctaaaaatagtttttagacaatcatattttctcaagtattttaacattatgatcattatgataattctccaaggggaaattatacttattttttattcatttattcattcatttggcaacaatatattgaacatttaccaagcaccaaactggctctaccgcttaatagtggcatgacgttcatcaggaaattgttagtgcaatcaagaacactagagattcactgggagaatttaaattagcttttagaaggatattatattagaattgaggcacttgatgaatctataaataatactatgttttcatgctagagatcgtgccaatgaagatatttactttgaaaaggggaagatgagaagtttaaaagcatttccatattgaagtaaatattcatttccatatcttcacagttatcttctcagagttctctgactcattgtgaaaaaaaattccaaccttctgcacagctctacgatcttcagattgttgcctagaggggtaaaatctattctaaaaggaggtgtgcactggatgagaatttagaattagatgaaataacccctagagtcttttcctgctttaagagcctgtgattccaaattctaacagtgcatttatcaagaaaaaaatatgctgaacattttagtagtttttgaatagtacctggataaaatagatacctaataaatgtgctcaatgaataataaataactgattaagatttaaataaacctcccaaatctctttcacattctaagatgggaagcataaaggttgttaatgaactagtgactgcgtgggtagctcattatttttaagtactcttgactttgctgttcattatctgtgtggccttaggaaaatacatatatttctgaaaggattatgtcatttgtaaaatagaaagtccttatctgtctaccacagatgattcttgtgcatatcaaaagaaatattcaataaggcatctgtaaaatagtagagagagatgaattaggggctattgtgattcgtttacattatgtcacaggtgcactttattagggatatgttttagagctgtcttaattacgtaattctttaacttagattgtgagaatgatattatggttatataggaaaatacccttattctaaggaaatgtatatttatgtctgaaacattgtatctgtaacttaatatagtatataaattatgctaatttacatgataattatatgtaattatattactatgttactatgtatacaatctatttacatgcatgtatgtgggggaatgttatcctcggttagtgtagtaggagttatcatgctcaaattcaatatctccacccttccaactcttcatgcttttctagcatggtgaggactgctgaactccatcttttgctggtagtctctctgtcaaatagaactgtttccaaattcagtcatttactccttgaaggctatgaattcatactttgttatatttttctggctgcatatttaaattactcttacaatcatataagttcattgtaaaaattttcgaaataaaaaggaagataaaatgtacagataattttagcaaatgaaataataattctattgggatgttttcttcttagattttaattatgtacattcccatcaactttttattttgaaaatgtttaagcctacagaacagttgaaagaacagtacaggccaagtgcagtggctcctgcctgtaatcccagcactttgggaggctgaggtgggtggatcacttgaggtcaggagttcaagaccagcctggccaacatggtgaaactccgtgtctactaaaaatacaaaaattagctgggcatggtggtgggcacctgtaatccctgctactcgggaggctgaggcaggtgaatcgcttgaaaccaggaggcggaggttgcagagagccgagatcacaccactgcactccagcctgggcaagagaatgagatctccatctcaaaaaaaaaaaaaaaaaaaaaaaagaaagaatagtgcagtatacactcatataccctacacataaattcattgattatttactttttgccctacttgttctttcttgctctgtttgcatatgaatgaatcgctgaaattaagttgtagacatcatgccatgtaatctctgaacagtgtgtgtgtatttctttagaataaggatgtttaatccagtctgtcactgagggacatttggattgattccaagtctttgctattgtgaatagtgccgcaataaacatacgtgtgcatatgtctttatagcagcatgatttataatcctttgtgtatatacccatacaccatggaatactatgcagccataaaaagggatgagtttgtgtcctttgtagggacatggatgcagctggaaaccatcattctcagcaaactatcgcaagaacagaaaaccaaacactgcatgttctcactcataggtgggaactgaacaatgagatcacttggactcgggaaggggaacatcacacaccggggcctatcacggggagtggggcggagggagggatagcattgagagttatacctgatgtaaatgacgaattgatgggtgctgacgagttgatgggtgcagcacgccaacatggcacaggtatacatatgtaacaaacctgcacgttatccacatgtaccctagaacttaaagtataataataataaaaaaaaagaataaggatgtttacttacatgatcataataccattatcacagctaagaaaataattcagttgattttttccacatatttgataactttctgtctatccaggattctatcctacattttcttttaatttatgtcatagcatatcatcttagaaagtgatccttaagttactgcatggtatacattgtttaattgtttaaccatttccctttgtgattggatttctttaggttgtttatatttttattattatcacaaatgttgaaatcactctttttttctgaagaatttaaaagtaatttatctctcttgtggaataaaagatttatttccccttaaaagaatttcaggcatgaacccaagagagaaggcattttttgttttagttgttgttgttatttttattttttattttttgggtagaaggagcaaagtgacaagttcaggaaataatgagagtgttagaattttggtcaggttaaagtgagttggagtgaagtttagaaatctttctgctcatctctcctgtttttaaaacactgtcctggaaatagttaatattaggaatgagaaaaatgatataggttttcctagtaagctttatttcttaattatgaaatactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgaattagtctgtctgacgagacacattttattacctaaaaacgtaattgttgactgcatggttgctacacatcacaacagcaggaatgcaagcatttggctgggctgtgggcacaccaacagaggacagctctcatttcttgacttaaatactgaaggatacacttctgaggtaaatccaatgctctttaaatcttttgtaatttaaagcatataccagttagaaagttacttagggataattttttaaatttattttgtacaaagtaaaaatttacaaattttacttttacaaagtaaaaacaaaagtataaatgttttacaaagaaaataagagccaatgtaggaatattattcaattagccttctgttagaacaagagtattcagggggacggagcaagatggccgaataggaacagttccagtgtccagctcccagcgcgagtgacacagaagaccggtgatttctgcattttcaacggaggtactgggttcatctcactagggagtgccggacaatcggtgctggtcagctgctgcagcccgaccagcgagtgctgaagcagggcgaggcatcgcctcacctgggaagctcaagggggaagggaatcccttttcctagtcaggggaactgagacacacaacacctggaaaatcgggtaactcccaccccaatactgcgctttaccaagggtcttagcaaacgggcacaccaggagattatatcccatacctggacgggagggtcccatgctcacggagcctccctcattgctagcacagcagtctgcaatctaacggcggctgggggaggggcacctgccattgctgaggcttaagtacgtaaacaaagccgctgggaagctcgaactggctagagctcacagcagctcagggagggctgcctgtctctgtagactccacctctggggacagggtacagcaaaacaacaacaacaacaacaacaaagcagcagaaacctctgcagacacaaacgactctgtctgacagctttgaagagagcagtggatctcccaacacggaggatgagatctgagaacggacagactgcctgctcaagtgggtccctgacccctgagtagcctaactgggagacatccccactaggggcagaccgacaccctacacctcacacggtggagtacacccctgagaggaagcttccaaagcaagaatcagatgggtacacacactgttcagcaatattctatcttctgcagcctctgctgctgatacccgggcaaacagggtctggagtggacctcaagcaatctccagcagacctacagctaagggtcctgactgttagaaggaaaactaacaaacaggaaggacacccacaccaaaacccaatcagtacgtcaccatcatcaaagaccagaggcagataaaaccacatggatggggaaaaagcagggcagaaaagctggaaattcaaaaaataagagcgcatctcccccggcaaaggaacgcagctcgtcaccagcaacagatcaaagctggatggagaatgactttgacgagttgagagaagaaggcttcagtcgatcaaacttctcagagctaaaggaagaactacgtacccagcgcaaagaaactaaaaatcttgaaaaaagagtggaagaactgataactagaatgattaatgcagagaaggccataaacgaactgacagagatgaaaaccatgacacgagaaatacgtgacaaatgcacaagcttcagtaaccaattcaaccaactggaagaaagagtatcagcgattgaggatcaaatgaatgaaatgaagtgagaagagaaatctaaagaaaaaagaagaaaaagaaatgaacaaagcctgcaagaagtatgggattatgtaaaaagaccaagtctacgtctgattggggtgcctgaaagtgagggggaaaatggaaccaagttggaaaacactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagttgtaggttggtgtctgtaatggggcaggatgatttccaggaggcattaagattatataccccatatatttctctggtttaagttagtattggaaaaaaagtattagaaaaatgtgaagcctgtttttggaacctgaaatatcagctccactggcagtttcggagttgaaattatttgaatatggtcaaagaaaaatttcaatggatgggattgggccaggaagactttattcaagcctgtcacaacaggggagagagatctgattgaactaaactccactgaaataaaaggtgggagaattttaagtgcaggggtgagctaatggaaaagtacctgaggatgtgttgtggggaagtgggagcagttgtcaatgtgattaggccatctgtgcttgctaattgtcccttcttgaaggtaggctcctattctcctacagacactagagaatagtcgtccttccttccttccttccttccttccttccttctttccttccttcctttttttttgaatgagttttgctcttgttgcccaagttgtagtgcaatggcaggatctcggctcactgcaacttccacctcctgagttcaagcgattctgtagcctcagcctcccgagtagatgggattacaggcatacaacaccaaacccagcaaattttttgtgtttttagtagaaatggggtttcaccgtgtcagccagactggtctcgaactcctgacctcaggggatctgcccacctcggcctcccaaactgctgggattacaggtgtgagccaccgcaccaggcctctttcttgataattacatttcaaaggaatggctcccaagtccttggaaaagacattcctggggtataaaactggaaagagtctgggaaaaggggcagagaaagaatttataattgcaagtcttctaaagtaaatactctaagaaaagggaggttaggagtttatagttgagaagtctatctaaagtttaataaagcggaggagaacattaaggccattttagccaatgtacatgttctttttgtaacaatttcaacatttttccttttagcaaacaaaaaaattttcttttggttggaaccgctgatggcaatttagcaatttttgaagataaaactgttaaggtaaatgttgaatgcattctacatctaaatttattttaagtcttttgttttatatatatctcactgccctcttatgggattataaactccctgagagcaagaatcataaattatgcttatatttgtattgcttcataaagtcttgcacacagtagatcctctgaaaatacttgctgattgactgtatattttatatgaatgaactaagaataagatgataaatgacatctgattgataatgttaggaatggaaataattcaatttgtacagatttgtatctgaggcagataagataattccttataaatatattgtgggaaaaaaaaccaaaaagatacttaagttttaaatatgacttgccattaactttttcttaagcattgaagaaatcatttaattttgtgttcttcagattcttatttagtcattaaagcatttattcctctatccatctattcatctttggttccatctattcactctacttcctacccgttcattctcctattaccaaaaagcttattatctgaggagagacatggaagtagactataataacccttaggttatttcttatgtaatttttacatggggaaaaagaatagattgaatgtaacaataatattttgaatatgacttaaattttttaatatatagtatttgtacatatttatggggtacatgtgatatgctgttacatgcatagaatgtctaatggtcaactcagggtgtttaggatatccatcaccatgagcatttatttctatgtgttgagaacatttcaagtcttctcttctagttattttgaaatgtttttaactgtagtcactttattgtactattgaacattagaacttattcctcctatctaactctgtgtttgtacccattaaccagcctctcttcatcctccccttctcccacacacccatatccttccaagcctctgataactatcattctactctctacctccatgagatcaacttttttagctcccacatatgagtgagtacacgtgatatttgtctttctgtgcttggcttatttcacttaacataatgacctccagttccatccatgttgctgtatatgacatgatttctttcctttttatggtcaaatggtattccattatgtaaacacacacattttctttatgcattcattcattcatgggcacttaggttgattccattttttagctattgtgaatagtgctgcaataaacatgggtatataggaatctctttgatatactggttccctttcctttagattagtatcagtagtgacattgttggattgtatggtagttctatttgtagttttttggagaaatcaccgttctgttttccgtagtggctatagtaatttacatacccaccaacagcatatgggcattccgttttttccacatccttgccagcatgttattttttgtcttttttacaatagtcattctaaccgggtgaagaagatctcagtgtggttttcatttgcatttttactgatgattagttaatgttgagcattttttttcatatatccattggccattactatgtcttcttttggaaatgtttatttagatcctttgcaaacgttttgttttgttttaagacagggtctcgctctctcacccaggctggagcacagtggcatgatcatagctcactgcagccttgaccttctgcactcaagtgatcctctaacatcagcttcacgagtagctggcactacaggcatgtgccaccatacctggctatttatttttattttttgtggagatgggaccccactatgttgtccagactgatctcaaactcctgggctcaagcaatcctcctgcctcatcttctcaaagtgctgggattacaggcatgagccaccgcaccctgctctttgtctacttttcaatggggttctttttttttttttttttttctgttgagttgctttttcgagtttcttgtgtatcctggatgaatagtttgcaaatatttcctcccattcaacagatcgtctctatattgttgatagtttcctttgctgtgcagaagctttttagtttattattgtcccatttgtctatttttgtttttgttgcctgtgcttttgggatcttaaccataaactctttgtctagatcaacgttctgaaatgtttcccctgtttccttctaacagtttcatagcttctggtcttacatttaagtctttaatccatcttgagttgatttttgtaaatagtgagagagtggggtctagtttcatccttctgcagactgatatccagcttttccagcacaattttttgaaggtagttttctttctctcatgtatgcttttggtgcctttgttgaaaatcagttggctctaaatatgtgggtttatttctgggtcctctacattggtctatgtatctgtgtttttgccaacactgtgctgttttggttactctagccttgtaatatattttcaagtcaggtagtgtgatgcctccagctttgttctttttgctcaggattgttttggctattttggctcttttttggttttataatttttttttctatttctgtgagaaatatctttggagctttcatgggaatttcattgagtctgtagattgctttgggtagtatggtcattttaacaatattaattcttccagtctgtgagcatgaatatctttccatgtgtttgtgtcctcttcaatttctttcatgtttttcaggtttccttatagagattgttcatcatcttggttaaatttattcctaggtgttttattaattttttgtagctactttaaatgggattgctttcttgatttttcagccactttgttcttgtgtagatatgctactaatttctgtatgttggttttgaatcctttattgtccttatttatcagaactaagggttttttttttgatggaatctttaggtttttgagttttaattttaatatctctaatcatttaagatggaaagtcgttttttgaaagcacagatttttagtgttttattctgtggatactcaatttgctgagtgtgttttatttttttttttttgacaaagcttgaaggagctgctcctttgaagatactaaatataggaaatgtcagtactccattgatgtgtttgagtgaatccacaaattcaacagaaagaaatgtaatgtggggaggatgtggcacaaagattttctccttttctaatgatttcaccattcagaaactcattgagacaagaacaagccaactgtaagttattttttatctgtacaagtaatttgtcattatctttatgtttattccttataatcattaataatactgttgataattcataaggaagatcttttaaagtgcataatttatttctatcataaaattaaacattcattataaaaaattttaaaaatttcaaaaagcagaagggtatttttaaaaagtcactcagcctaatatatagtaatatatagcctaatatatagcctaaacatacttttagggataaaatatgtaaacccattgtaatcttagtagtatttatcaatctaaatttttaaataatttttattatctgtgtttcaaattagacatgaaattggaagacaatcaactctgcattttaccaaattcatagactttacatatgcaatttgggtaatttccattaagtattgattgtaggaaagatagacagcaagtattcttgcttgtctcaagttgtttctagatttgataattatacagatgtctactaacaaccaagttagtgataccagtttcaaacaagagtaaaataaaatattaatataaacctctttcaagtttgtttttttcagttgtattttaatcaaatctttgccattggtccttatttatcacattcctcagtgataagcagtgtaggattgtggataagagcataaaccatagttcacgtatcgctttgccatctattggttttgtgaacttgggcaataacctttcacatcttcagtcatctcttacctgaggattgtaatattctctatctcaaagggatatttggaggagtaaataagaacattaatatatggaacttaattaacataacgaccagcacctggtaagctgtcaataaacattagctattgttgttattattattattagctttgagtcacaaatccctaccttagagaatatcctagtttcccaatatccatctaattgcccaagattggcacttgggagtaatctttgactcctttgtttttgctccctttatccacttgaccctcctaattgtcattcgaatctttgtacttctcactgttctcagtgctgctaccataggccagactgccatccatcatctgtggccacattaacaagagcatccagttctcatcctctgattacactctcttccacctattttcagcgttgcagacagagggacctttctaaaatgtacatcaatctgatgcaattctcctgcttaaaacccttcggtggcatcccattgtcctttatatgaagtccagattccttaagatagcctactgggcccttcataattcagtgcttgcttagctgtctagattcatattttgcaaccttcttgtcatctgtgctttacccaaactgaaattgactcagatctctaagataacctgttacctttcacccccagcctttgaatgtagtattctctttacctggataactattatgcaccctgcctatttcagtccaaatgccacttgctctgagtggcaggttaggtaactttgtgcttccattgcatctattgttttccatcacaatagccattttatttttataattgtattttttaaagtagtttcttaataccactaaatctactagttttcaacattggctgtgcaattagaaaccactaggtagctgaaaataatgatacctgggccctacctcagaccaattaaattagatcagttaagcctgggatggggatcagacttgtttttttttcaggttctcaagtgattctaaagtatattcgaggttaagatatactgcagactgcaatgtattgtaagttcccatgaatgaggatttttatttctgtgtgtacatatttgtttactagtatgtggttaacatttagatcaactcattttcattctgtaacacccactttttaaaaaatgaacgtaaaaatgtattttattatttttatctttcaaattttattttagactccaagggtacatgtgcaggtttgttaacaaaggtatagtgagtgatgctgaagtttggaatacaactcaactcacaacccagcaagtgagcatagtactcgataggtagtttttcatcctttttccccttcctgtaatttccacttttaacctaattatacaagcctgaaaacctttaaaaagaaagggcctccagtttatttttttatttcgtaagacattttatgggctcatggatatcaattaagtccttaaagttccatataagatttggagcacagatgctttactagagagcatccataaagatcaagctctcaaagatgttcatctcccaaaagagattgggacttagttgcataaacacttagagagaaatatttgctctcttctgaacaagtatctcctgtggccttgatctctaccccacgaaacagacatcacatcacgaatcagaggttgcctcattatcagtaccctcatcatcatcaatacacaccgactgagaggcatattgagtaatgaaagatgactgcctttgaagccagaagactgcacaacttgtggagttctaggtctgcaacatgtttttagtcctaggtcagcaagcatgacgtcagtagtcatggaaccctgagcaaattatttagcatttgtacatgtttctttctacaattaaaaacattgagatttgtcatattttatgtttttttaattaagggtcaaacaagatagcacacaaaagtattttataaaatacgaaaattccctgcaaaactttatcctaattggaactattttctattaaatacagcaaacatccaggaaggcgttacctaaaacatagtggctctctgacaacacatcatatttttatctccttttccagaatagaaagaaaagggggagaaaaaaaaatcttcctgctctaggatgtactaatgattgttgaatcattatggtattttcatgttatctatctgatttaaatgcaattttgactatttttacttattcctggttgttcattcatactggagtgccgtctatcccccacttcatagactgcttggtatatcagaggtgcttatctgtgcaactctttactggacgagggttatgtagaaaatacatcgtcctcatccttacgaaattacactcataatctagtgtgagggatgccctaataaagacaattttatatttaataaggtctataatatgacagtgacaccagtggggaaaagggactggttagtctattttgataggtcagggaagaaatccagaggagctgacatttaagttaatcctcaaaggccgagtaggagtttgccgtgttgatgtggcccatggtagccaatctgtttgtgaaatatgtacaatgtcagatgccttaggttgaaagggaaatattttaaggtgtttgtaatttttctttatgtttaaaaggggaaaatggcaaatattttactttctgtttatgtttgaatgatgtggatttttgtttcctataatttgactggctcaactgcaaagatataccttgctttaaaatttgaagacactgcaactaaattttttttcaacattttatattttataactctagatgtaaaaggctaatgcttagttttctgagcattcatgaaacaaagttttgcaacgacattcaaaagttacagatattataatatttccttcagaaatttagatatagtataaaattctacaaagagctacatagaattgaaactaaaagtaagtccaaagtcaacattggacataatctttattttattatcaagagaaattagtataaagtaaccaaaagtatgtaaaataccaaagcatgttatatattcaattcagaattgttagggaagaatatgaaataattgcaatagtctagcttgtttagttttcaaaatagtgtttttacatgcattaagaactaaggttgtattacacgtagaaattttaagaagaaaacaaatagtgatgactttctatttttttttctctgtaggttttcttacgcagctttcagtgattccaacatcgtaacagtggtggtagacactgttctctatattgctaagaaaaatagccctgttgtggaagtgtgggataagaaaactgaaaaactctgcgaactaatagactgtgtgcactttttaaggttaattcattggcttttaagtttatttccaaaagaattatctttgcacttcatgtgtcgcagaggaaggatttgtcttcctttctgcctctgaatagagaattttttaaaaaagcagaaaaaaaattgtaatgcttctcagcaccagctcttcaaatcaggaacattttgtcttgggaaaataaaaaaataggagcataatatgcatagttttttcacggtattataaagaatgctctcgaatgaaaatagtatattattgaaaatgagcatactggagtctctgctagctttgatgtagttgtgtcacagtgtcaaatatactatttataattaaattgtgggccccaagattatctgctcaaagaaaaagagtcacaaaataatagacgaatatggggggaaacacaatggactcagcaaggcactaactaaggagttgggatcaagacctcagaatgagagcatagtgcttagtctgatgcagccagtgagtgacaaatccatagcaagcacattctttctgtgctggtgctaagaaacaggaccattttcaagcttatttgctagctactttatatttttattttattttggttttaccttatagatctatgatactcttaagaacatttgagattacacactgtatctgtaaaaggagacttcaaagtttcctttcttagattcatctgacagtttttctctcgattgtgagaagggctcacagtttatgttcagaagaaccaacaggtctccttgataaaggattccttacttcctggagtaccaaaacgattaggattcttttatttctggacacttcattttggtcgtgaattagactattcactggttctgggaaaaaatccagtggtttgtatggatatctcttacatgtgaatgactataattttacgttcctttgtaacactgagacatcatgtaaagcttttgagtctaacttttttttctttatcctgggcacatgcatgctatttttactgaattagatagctttggtatttataaaaattgtatccctcttattcataatttcctgaaaatgaagggctattgttgtctttgataatttatgcttcaagtaaagaaatgtggctctttggcattctgtgtttagcaaaatttgctttgtataattttaatgatgcataatgtgtggtgtcatgttttcataatttaaaatgttatttatgttttcatatataaatagcatttatgtcttagctggtggtaaaattattaatgtatactttatggttctagggaggtaatggtaaaagtaaacaaggaatcaaaacacaaaatgtcttattctgggagagtgaaagctctctgccttcagaagaacactgctctttggataggaactggaggaggccatattttactcctggatctttcaactcgtcgagttatacgtataatttacaacttttgtgattcggtcagagtcatgatgacagcacagctaggcaagtttctttcctttagatatttttcatattctctaagtcttataaaatatgcctttattttacatttactttttctctgcactttccagtgtcatttggatggtcttggaggttcacacaatgaaacataagactggtgtaaattgtgaatagggtcattacagaaatggtgggagtaaatgctctcagtcccataagagaagcagattactgcagctgaacactcagtttgggtcttacttgcttttttcctttttacctaaggcaaaaatgggaaatacatagtgttgaatatatttcactttttgagcaaagaaaataaagaaaatgtttattttaatcatagtatagcctcccacgcttgttaaagaatctcatttagtttttcattctataacaaatctttattcttgcagcaatacatgccgaaccacacaacctacaaatattgacaaatcatgttttactgaaactttgtctttttttgcttctatttttctatttaaatatgatgaaatcgtgatagcacataaaatatattttctgcataaatatatttgtgtcttcctttgataataatttgatttagaaaataacaataaaagcacatatacaaaagtttacaaaaacaacactatggggtttaattccgaaaaaaactagaatttatgtaactttagcaaataattaatgaatgttttgaacgtggtgaagaaaatagattcattacaagtatgtgtgaaagaggaacatgtgtttctctaacaccttcacctatttttcatttatagacgttagagttgcacagaaggagttagaattagatgctcttaatgactgtgaactattaagatacatgtccacacaagcagaacagtaggtatctcaatgggttgtctccgtagtcttattctaccaaagttgttgcattctctagttgaattgtatgtactttgggacccggatagcttgcttataactgaagttatagtggaatttcaatgggttacagtttgattttaaaataaagatcaatttgaacatagcctacaaggtgctgcgtgagctggcttcactgtacctctcctgcctccatcatctaccacattcctaccagatcttcctcgtctagatgaacatccagttcttcttaattactgtgctatattttgcctcagagatttgcacatgctgtttatttctttgcttaaagtaggttttttatgcttagttaactcatacgctttgaaatgttagctcctgtgtcaaaacctctgagaagcaaacactgattaggtcaaagttcccactttgggttcccataacagctttcttgcatagttgtgatcatagtcatatatattttttttcattaatactagtctcttcactagaatataaacaccaagcaggttgggttagtgtgttttggtttacccctttattcccaggatctagcctaggacttacatagaagacttttgatgcaaatttgttgaataaattagtgaatgatttgagaagaaaatatgatattttgacatcagtatatccatccatctaagtgtccatctaaatactcatatttgtaccttaccatatccaaagaacttttcacacacattacctcatttaacattgtaactttggggagggtaatgtataaatactaagcctattttatagaaaggttaagctgttttctcagactcacataattaagagttgcagcaaggagtggatcacagattctgttacttttttttaatgctggcctttattcaatataatttaagggtcacctagaaaatagaactgtgaattcagttccaaggtatttgtgtcttagactatgaacaactttaatttttttcagaccagcttaatatatagttttaacggaaaacttccatattttgtttttgtaaagggagccttaaaaatgtcatgctggtattgggctataaccggaaaagtactgaaggtacacaacagcagaaaggtaacatttaaaaggatactgtattccaaacagtgcaatgacatgaatgatagtaacatattatgtgttttataaatttgtagaaaatattacatatggtataatcaggaattttaattggtagtttatagtataaagaacttaggcataaactttcaaaattacaagtgatatgaagtgttaaatatttatattttcagatgaagtagaggtgtcaatcactagctcaaccttaaactaaatgtgaatattttttacaacttacctgtatctacataatgtttaattttcaacagtgtttgaaaagctttatttcttttagattatgaaatgttaatttattaaatgtccacactcttcttgaaatttagtagtttctataatgtattataaaaattgtccaagtacagttttttataaataattatttagtgcattagttatagctgtgtttatatatacatttatctaagtcaactaaaaatacataagccaaactgaaataaaataagaatgttttatggtggatctttgaaacttgatttcatttttttctttttctagagatacaatcttgcttgactgtttgggacatcaatcttccacatgaagtgcaaaatttagaaaaacacattgaagtgagaaaagaattagctgaaaaaatgagaggaacatctattgaataagagagaaacaggaattgtctttggataggaaaattattctcttgtaaatatttatttaaaaatgttcacatgaaaagggtactcacattttttgaaatagctcatgtgtatatgaaggaatgttatatttttaatttaaatatatgtaaaaatacttaccagtaaacatatattttaaagaactatttaaaacacaatgttgtatttcttatgaataccagttacttttgtgcattaattaatgaaaataaatctgtgaaatacctaatttaagtactcatactaaaatttataaggccgataattttttgttttcttgtctgtaatgaagataaactttattttaaattctatgcttaagacaagactattgcttgttgatttttctagaaatccgcaaggtagaatgaaaatattaagacagtttcccgtgtaatgtattccctcttagattgctttgaaatgcactatcatatatgcttgcaaatattcaaatgaatttgcactaataaattcctttgttggtatgtgaattctctttgttgctgttgcagacagtgcatgttacacaacttcactcaatccaaaagaaaactccattaaaagtactaatgaaaaaacatgacatactgtcaaagtcctcatatctaggatatgaggagagtttctgtgtctttctgtgtctttcctagacatgatagagttgtctctatcttttcaactctatctttgagtatggataccctgaattttgtataattagtgtaaatacagtgttcagtccttcaagtgatatttttatttttttattcataccattagctacttgttttctaatctgcttcatcctaatgcttatattcatcttttccctaaatttgtgatgctgcagatcctacatcattcagatagaaacttttttttttcagaattatagaattccacagctcctaccaagaccatgaggacaaatatctaacacttttcagttgctgaaggagaaaagagctttagttatgatggataaaaatatctgccaccctaggcttccaaattatacttaaattgtttacatagcttaccacagtaggagtatcagggccaaatacctatgtaataatttgaggtcatttctgctttaggaaaagtacttttggtaaattctttggccctgaccagtattcattatttcagacaattccctgtgataggacaactagtctatttaatattctcagaacttaatggcatttgactatatgaaaactttaaatttatttatattcagggtgatcaaattcttaaacatgaaagattttctgtattttaacttgctacgtaattaacgacaacaaaaaaaaatacagtagagctctttgttccagtgttatctctttcattgtcactttgtatgtatttgcaaatttttttaccaaagacaaacacaaaaatagaatactgtatttacatggaataataaaatttttaaaagcatgtttatgaatttttaaactttgtgatagtgttttgcttttcacatacaggtctgttatccacctcaaaggaaactttgtatattaatttgtatatggaacattccacgataagaaagtgcaactaaagttttttcttgagaacttacagaatatttaaatttacttttctataatacgtatggttgccaggatcccaggacaaaatctgatgggtatgaaacattctattttcaagttctcttaaaaatgttttgtgagtaaatttgtttgctcttgagtactgaaacaaaatataagactttagagcaaatgatatatacaaaaaataggcacagtcacttcaagtgttttctgattagaagcctaaaataacctgctaattatgatcaaaatacaaacattatcataacagaaaatattcttttgggaaaattttgaattcaaaaaagggcgcctctctgactctaattcactctatcgattatgtgtgaactattttaactaaaatgcaacttatttttcatcaaggcagtgaaatatattgatgaaacatagcagaaatgttctaatattgaggggagataaaattcaaaaccgttgggactttgcttctttatccatcactttgagtagcttaacacctaacctggtaaattgaatgtttttcatggaggctcatcagcaattcagtaaaatagtaaactatgtcaactcgggagaaactgacatcctcgttctccatgctagccagttgctgatccagggtatcattgtttctaataacaattcagaatctggctgcttaaaggcacctaggtacttggttctttctaatttgtcaaggaatttggagtgatcctatcaccctgatttcaagcaagagacagtcacctgacccaaaggcctgctgtctgaacacactctgagtgagtgagcagagatgtggtggttctctctatgtgctgccgccacactgctcttgatttctacccttacctgggaagtctctacttgatgtctgtctcaggctaagaaaaagagaagagaaagggaatgagtattagcatctggatcatggggctgcttcttggcctctatgagaatccactgtttcacagcaatcacggcctacaaaactggatgttatagagtaaacaagaggtatcattctgacctgggcttcgccacatttacccactgaacactcccaagagaaggttgttaccatttatttatgaaaataccaaactccgatacatactctattagaagtattatggaaaagtagagcatatgtctacctggccagagaatagaggatcctgatcacaaaaaaagtacaaatatttaaacagggacttaggacaaacgggcattcaacaatttccagagtgaaataacattctaggcagatgatgacacatgtgctgtcttaggaacttgagcttattttgaaagcatccctatcaaatacatgctgaaatttgtgacaagttcccattccttacagtacttacgggatacacttaagtgactgaagatgcaagagaagtatatatttgtgtatggatatagcacttttatcattaattgggagattataaagttaatgagctgttctttgcagagggagtatttgttaggatgaaatggggagagatgtttcaaacaccaagtttattttataggttaagaaatcctagaaggaatccatgactttatgtatatgtacaatatatga

SEQ ID NO: 4-10 - skipped (7 entries)

SEQ ID NO: 11 - DNA, 22 bp, Artificial sequence
  Primer
ttccacacttgcggtctttaga

SEQ ID NO: 12 - DNA, 20 bp, Artificial sequence
  Primer
gcgggacctggtaggtactg

SEQ ID NO: 13 - DNA, 15 bp, Artificial sequence
  Probe
atgagcagcaatgat

SEQ ID NO: 14 - DNA, 25 bp, Artificial sequence
  Primer
catcactcaggctgttaagacaaga

SEQ ID NO: 15 - DNA, 22 bp, Artificial sequence
  Primer
cagctgccagcaaagatatcaa

SEQ ID NO: 16 - DNA, 22 bp, Artificial sequence
  Probe
ctttgccacctccaccacccca

SEQ ID NO: 17 - DNA, 21 bp, Artificial sequence
  Primer
gagcttcctcacgcagttcac

SEQ ID NO: 18 - DNA, 22 bp, Artificial sequence
  Primer
tgctgggtcttgaaaatgaaga

SEQ ID NO: 19 - DNA, 21 bp, Artificial sequence
  Probe
ttctaaatgaatcaggagtcc

SEQ ID NO: 20 - DNA, 23 bp, Artificial sequence
  Primer
ccaggtacaatgcaaagcttaat

SEQ ID NO: 21 - DNA, 22 bp, Artificial sequence
  Primer
tcagtccaatcactgacaagtt

SEQ ID NO: 22 - DNA, 24 bp, Artificial sequence
  Probe
ttgggaagtccttggtgttcacca

SEQ ID NO: 23 - DNA, 19 bp, Artificial sequence
  Primer
ggcgagttatccgcaccat

SEQ ID NO: 24 - DNA, 24 bp, Artificial sequence
  Primer
ccaaaaccagcatgacattcttaa

SEQ ID NO: 25 - DNA, 23 bp, Artificial sequence
  Probe
tgagagccatggccacagcacaa

SEQ ID NO: 26-29 - skipped (4 entries)

SEQ ID NO: 30 - DNA, 20 bp, Artificial sequence
  Synthetic Oligonucleotide
attaatttgcacagaagtga

SEQ ID NO: 31 - DNA, 20 bp, Artificial sequence
  Synthetic Oligonucleotide
gacttctattaatttgcaca

SEQ ID NO: 32 - DNA, 20 bp, Artificial sequence
  Synthetic Oligonucleotide
accaaggacttcccaatcat

SEQ ID NO: 33 - DNA, 20 bp, Artificial sequence
  Synthetic Oligonucleotide
gtgcatggcatcaaaaatta

SEQ ID NO: 34 - DNA, 20 bp, Artificial sequence
  Synthetic Oligonucleotide
tccacatttctgaatcccag

SEQ ID NO: 35 - DNA, 20 bp, Artificial sequence
  Synthetic Oligonucleotide
tcttggtcatctggatacat

SEQ ID NO: 36 - DNA, 20 bp, Artificial sequence
  Synthetic Oligonucleotide
cactgaatttcttggtcatc

SEQ ID NO: 37 - DNA, 20 bp, Artificial sequence
  Synthetic Oligonucleotide
cccagacactgaatttcttg

SEQ ID NO: 38 - DNA, 20 bp, Artificial sequence
  Synthetic Oligonucleotide
gaggaatctctttcagttta

SEQ ID NO: 39 - DNA, 20 bp, Artificial sequence
  Synthetic Oligonucleotide
aaccttatgatgtctttggc

SEQ ID NO: 40 - DNA, 20 bp, Artificial sequence
  Synthetic Oligonucleotide
gaaacatccaaatgtgtgcc

SEQ ID NO: 41 - DNA, 20 bp, Artificial sequence
  Synthetic Oligonucleotide
tgcttctcatcagaaacatc

SEQ ID NO: 42 - DNA, 20 bp, Artificial sequence
  Synthetic Oligonucleotide
tcctcggtggcattcacaaa

SEQ ID NO: 43 - DNA, 20 bp, Artificial sequence
  Synthetic Oligonucleotide
ccacttgggttccacaaagt

SEQ ID NO: 44 - DNA, 20 bp, Artificial sequence
  Synthetic Oligonucleotide
tacaaagccacttgggttcc

SEQ ID NO: 45 - DNA, 20 bp, Artificial sequence
  Synthetic Oligonucleotide
ggaaaccattcttccatgag

SEQ ID NO: 46 - DNA, 20 bp, Artificial sequence
  Synthetic Oligonucleotide
tttctaggcaggtcagccaa

SEQ ID NO: 47 - DNA, 20 bp, Artificial sequence
  Synthetic Oligonucleotide
agcaggcgatccaaggaacc

SEQ ID NO: 48 - DNA, 20 bp, Artificial sequence
  Synthetic Oligonucleotide
caatgatggcagcattggga

SEQ ID NO: 49 - DNA, 20 bp, Artificial sequence
  Synthetic Oligonucleotide
tgttggttataaatgacatt

SEQ ID NO: 50 - DNA, 20 bp, Artificial sequence
  Synthetic Oligonucleotide
tgaggattttctttcaaaca

SEQ ID NO: 51 - DNA, 20 bp, Artificial sequence
  Synthetic Oligonucleotide
ttcaaaatgtcaaagacctg

SEQ ID NO: 52 - DNA, 20 bp, Artificial sequence
  Synthetic Oligonucleotide
aagtgacagaatcagtcatc

SEQ ID NO: 53 - DNA, 20 bp, Artificial sequence
  Synthetic Oligonucleotide
tgagtttctgaatggtgaaa

SEQ ID NO: 54 - DNA, 20 bp, Artificial sequence
  Synthetic Oligonucleotide
gctgccactagccatggtgg

SEQ ID NO: 55 - DNA, 20 bp, Artificial sequence
  Synthetic Oligonucleotide
tcctggacattgttcagcct

SEQ ID NO: 56 - DNA, 20 bp, Artificial sequence
  Synthetic Oligonucleotide
tggacagacttctattaatt

SEQ ID NO: 57 - DNA, 20 bp, Artificial sequence
  Synthetic Oligonucleotide
agttccaagttgtaactgac

SEQ ID NO: 58 - DNA, 20 bp, Artificial sequence
  Synthetic Oligonucleotide
agagccaaggcttcatggca

SEQ ID NO: 59 - DNA, 20 bp, Artificial sequence
  Synthetic Oligonucleotide
tttatgatggttttccgaag

SEQ ID NO: 60 - DNA, 20 bp, Artificial sequence
  Synthetic Oligonucleotide
tgatctcggatcttgaaatt

SEQ ID NO: 61 - DNA, 20 bp, Artificial sequence
  Synthetic Oligonucleotide
atgaatactggtcagggcca

SEQ ID NO: 62 - DNA, 20 bp, Artificial sequence
  Synthetic Oligonucleotide
aaactgatttcagttcccca

SEQ ID NO: 63 - DNA, 20 bp, Artificial sequence
  Synthetic Oligonucleotide
accttggtcatctggataca

SEQ ID NO: 64 - DNA, 20 bp, Artificial sequence
  Synthetic Oligonucleotide
tgatctcggatctatgaaat

SEQ ID NO: 65 - DNA, 20 bp, Artificial sequence
  Synthetic Oligonucleotide
cccctggtgttcaaaagcag

SEQ ID NO: 66 - DNA, 20 bp, Artificial sequence
  Synthetic Oligonucleotide
tgtcaaagacctgagaaagt

SEQ ID NO: 67 - DNA, 20 bp, Artificial sequence
  Synthetic Oligonucleotide
cagcctgactatcaacttct

SEQ ID NO: 68 - DNA, 20 bp, Artificial sequence
  Synthetic Oligonucleotide
ggacttcccaatcatttcca

SEQ ID NO: 69 - DNA, 20 bp, Artificial sequence
  Synthetic Oligonucleotide
gaaaatagtctcagtgagga

SEQ ID NO: 70 - DNA, 20 bp, Artificial sequence
  Synthetic Oligonucleotide
ttaagaaaatagtctcagtg

SEQ ID NO: 71 - DNA, 20 bp, Artificial sequence
  Synthetic Oligonucleotide
ccatgatgctgttattctga

SEQ ID NO: 72 - DNA, 20 bp, Artificial sequence
  Synthetic Oligonucleotide
cattcaaccatgatgctgtt

SEQ ID NO: 73 - DNA, 20 bp, Artificial sequence
  Synthetic Oligonucleotide
gctctctttctcacatacct

SEQ ID NO: 74 - DNA, 20 bp, Artificial sequence
  Synthetic Oligonucleotide
ggactgctctctttctcaca

SEQ ID NO: 75 - DNA, 20 bp, Artificial sequence
  Synthetic Oligonucleotide
aatcctccaaggcaaatgct

SEQ ID NO: 76 - DNA, 20 bp, Artificial sequence
  Synthetic Oligonucleotide
aaaggaccaagccaagaagg

SEQ ID NO: 77 - DNA, 20 bp, Artificial sequence
  Synthetic Oligonucleotide
tggaaataaaggaccaagcc

SEQ ID NO: 78 - DNA, 20 bp, Artificial sequence
  Synthetic Oligonucleotide
acactgtccatagaagagtc

SEQ ID NO: 79 - DNA, 20 bp, Artificial sequence
  Synthetic Oligonucleotide
caaacacactgtccatagaa

SEQ ID NO: 80 - DNA, 20 bp, Artificial sequence
  Synthetic Oligonucleotide
aaaatcttcagttccttcag

SEQ ID NO: 81 - DNA, 20 bp, Artificial sequence
  Synthetic Oligonucleotide
agatgcagtttctctactct

SEQ ID NO: 82 - DNA, 20 bp, Artificial sequence
  Synthetic Oligonucleotide
cctcacgacctgcaaaatcc

SEQ ID NO: 83 - DNA, 20 bp, Artificial sequence
  Synthetic Oligonucleotide
gaattcctcacgacctgcaa

SEQ ID NO: 84 - DNA, 20 bp, Artificial sequence
  Synthetic Oligonucleotide
tctcatcagaaacatccaaa

SEQ ID NO: 85 - DNA, 20 bp, Artificial sequence
  Synthetic Oligonucleotide
ggtggcattcacaaagtggt

SEQ ID NO: 86 - DNA, 20 bp, Artificial sequence
  Synthetic Oligonucleotide
gatcttgaaattaaggctct

SEQ ID NO: 87 - DNA, 20 bp, Artificial sequence
  Synthetic Oligonucleotide
aatcttgaccaaaatcccat

SEQ ID NO: 88 - DNA, 20 bp, Artificial sequence
  Synthetic Oligonucleotide
tcttcaacagagtttctcct

SEQ ID NO: 89 - DNA, 20 bp, Artificial sequence
  Synthetic Oligonucleotide
gcccatttcttcaacagagt

SEQ ID NO: 90 - DNA, 20 bp, Artificial sequence
  Synthetic Oligonucleotide
atgttcttcaccatcattaa

SEQ ID NO: 91 - DNA, 20 bp, Artificial sequence
  Synthetic Oligonucleotide
tcaaattccaactcatcatt

SEQ ID NO: 92 - DNA, 20 bp, Artificial sequence
  Synthetic Oligonucleotide
aaaatcttcacagccacttc

SEQ ID NO: 93 - DNA, 20 bp, Artificial sequence
  Synthetic Oligonucleotide
attaaaaatcttcacagcca

SEQ ID NO: 94 - DNA, 20 bp, Artificial sequence
  Synthetic Oligonucleotide
gaggctggctttgtcctgct

SEQ ID NO: 95 - DNA, 20 bp, Artificial sequence
  Synthetic Oligonucleotide
ataatcatggctgagtggag

SEQ ID NO: 96 - DNA, 20 bp, Artificial sequence
  Synthetic Oligonucleotide
gatggcagcattgggataca

SEQ ID NO: 97 - DNA, 20 bp, Artificial sequence
  Synthetic Oligonucleotide
ccatattctttaactggatc

SEQ ID NO: 98 - DNA, 20 bp, Artificial sequence
  Synthetic Oligonucleotide
tctcaaccataggccatggg

SEQ ID NO: 99 - DNA, 20 bp, Artificial sequence
  Synthetic Oligonucleotide
ttcttgaggattttctttca

SEQ ID NO: 100 - DNA, 20 bp, Artificial sequence
  Synthetic Oligonucleotide
atgtcaaagacctgggcaga

SEQ ID NO: 101 - DNA, 20 bp, Artificial sequence
  Synthetic Oligonucleotide
gcaaccatgcattcaacaat

SEQ ID NO: 102 - DNA, 20 bp, Artificial sequence
  Synthetic Oligonucleotide
tctactatcagcaacttcct

SEQ ID NO: 103 - DNA, 20 bp, Artificial sequence
  Synthetic Oligonucleotide
aaacaagtgacagaatcagt

SEQ ID NO: 104 - DNA, 20 bp, Artificial sequence
  Synthetic Oligonucleotide
gtgtttttctaaattttgca

SEQ ID NO: 105 - DNA, 20 bp, Artificial sequence
  Synthetic Oligonucleotide
acttcaatgtgtttttctaa

SEQ ID NO: 106 - DNA, 20 bp, Artificial sequence
  Synthetic Oligonucleotide
aaataacttggaggctggaa

SEQ ID NO: 107 - DNA, 20 bp, Artificial sequence
  Synthetic Oligonucleotide
gacaaaactgatttcagttc

SEQ ID NO: 108 - DNA, 20 bp, Artificial sequence
  Synthetic Oligonucleotide
cacttaccaagaaaattcat

SEQ ID NO: 109 - DNA, 20 bp, Artificial sequence
  Synthetic Oligonucleotide
attatagaatttaatcttaa

SEQ ID NO: 110 - DNA, 20 bp, Artificial sequence
  Synthetic Oligonucleotide
acctccctagaaccataaag

SEQ ID NO: 111 - DNA, 20 bp, Artificial sequence
  Synthetic Oligonucleotide
tccgctgctcagggaaccgg

SEQ ID NO: 112 - DNA, 20 bp, Artificial sequence
  Synthetic Oligonucleotide
tggtgaacaccaaggacttc

SEQ ID NO: 113 - DNA, 20 bp, Artificial sequence
  Synthetic Oligonucleotide
gaatcaattggtgaacacca

SEQ ID NO: 114 - DNA, 20 bp, Artificial sequence
  Synthetic Oligonucleotide
ggaggagatctaaggtcttc

SEQ ID NO: 115 - DNA, 20 bp, Artificial sequence
  Synthetic Oligonucleotide
aggtgattttacctgaagtt

SEQ ID NO: 116 - DNA, 20 bp, Artificial sequence
  Synthetic Oligonucleotide
atcattggctggaaatgagt

SEQ ID NO: 117 - DNA, 20 bp, Artificial sequence
  Synthetic Oligonucleotide
ggaatgctttcatagcttcc

SEQ ID NO: 118 - DNA, 20 bp, Artificial sequence
  Synthetic Oligonucleotide
ttgtaacaggcttccagcca

SEQ ID NO: 119 - DNA, 20 bp, Artificial sequence
  Synthetic Oligonucleotide
ccctatgagctgggaaatgg

SEQ ID NO: 120 - DNA, 20 bp, Artificial sequence
  Synthetic Oligonucleotide
ccagggaagtgttgcttcct

SEQ ID NO: 121 - DNA, 20 bp, Artificial sequence
  Synthetic Oligonucleotide
tccagctgcactggtaatga

SEQ ID NO: 122 - DNA, 20 bp, Artificial sequence
  Synthetic Oligonucleotide
caggatttccaatgaacctg

SEQ ID NO: 123 - DNA, 20 bp, Artificial sequence
  Synthetic Oligonucleotide
tctgcagtgtgtgaagcact

SEQ ID NO: 124 - DNA, 20 bp, Artificial sequence
  Synthetic Oligonucleotide
tgatgcaccagcagcttaga

SEQ ID NO: 125 - DNA, 20 bp, Artificial sequence
  Synthetic Oligonucleotide
tttgcttgattggcatctgc

SEQ ID NO: 126 - DNA, 20 bp, Artificial sequence
  Synthetic Oligonucleotide
gttccaccaatttgggactg

SEQ ID NO: 127 - DNA, 20 bp, Artificial sequence
  Synthetic Oligonucleotide
atcttgttcacgagatccac

SEQ ID NO: 128 - DNA, 20 bp, Artificial sequence
  Synthetic Oligonucleotide
ggcaaatgctattgttggcc

SEQ ID NO: 129 - DNA, 20 bp, Artificial sequence
  Synthetic Oligonucleotide
gagtgcattctggtgaagct

SEQ ID NO: 130 - DNA, 20 bp, Artificial sequence
  Synthetic Oligonucleotide
aactcttcagagtttcacat

SEQ ID NO: 131 - DNA, 20 bp, Artificial sequence
  Synthetic Oligonucleotide
gggagcatatccctgatatt

SEQ ID NO: 132 - DNA, 20 bp, Artificial sequence
  Synthetic Oligonucleotide
ctttaggacaagcctcaaga

SEQ ID NO: 133 - DNA, 20 bp, Artificial sequence
  Synthetic Oligonucleotide
agaccgcaagtgtggaagat

SEQ ID NO: 134 - DNA, 20 bp, Artificial sequence
  Synthetic Oligonucleotide
tctaaagaccgcaagtgtgg

SEQ ID NO: 135 - DNA, 20 bp, Artificial sequence
  Synthetic Oligonucleotide
actgacatccagagatgtca

SEQ ID NO: 136 - DNA, 20 bp, Artificial sequence
  Synthetic Oligonucleotide
aggatcttagttccaagttg

SEQ ID NO: 137 - DNA, 20 bp, Artificial sequence
  Synthetic Oligonucleotide
gggaaaggatcttagttcca

SEQ ID NO: 138 - DNA, 20 bp, Artificial sequence
  Synthetic Oligonucleotide
ccccatttcattgggaaagg

SEQ ID NO: 139 - DNA, 20 bp, Artificial sequence
  Synthetic Oligonucleotide
ccaagatctgatttcttggt

SEQ ID NO: 140 - DNA, 20 bp, Artificial sequence
  Synthetic Oligonucleotide
agcaaggtacaatgctcgct

SEQ ID NO: 141 - DNA, 20 bp, Artificial sequence
  Synthetic Oligonucleotide
catggcatcaacttcagcct

SEQ ID NO: 142 - DNA, 20 bp, Artificial sequence
  Synthetic Oligonucleotide
attgaagagccaaggcttca

SEQ ID NO: 143 - DNA, 20 bp, Artificial sequence
  Synthetic Oligonucleotide
agcctttatattgaagagcc

SEQ ID NO: 144 - DNA, 20 bp, Artificial sequence
  Synthetic Oligonucleotide
agcgcgagcctttatattga

SEQ ID NO: 145 - DNA, 20 bp, Artificial sequence
  Synthetic Oligonucleotide
gaagaagcgcgagcctttat

SEQ ID NO: 146 - DNA, 20 bp, Artificial sequence
  Synthetic Oligonucleotide
gcagggaaccctcgcttatt

SEQ ID NO: 147 - DNA, 20 bp, Artificial sequence
  Synthetic Oligonucleotide
tagcagtctggaatcagctg

SEQ ID NO: 148 - DNA, 20 bp, Artificial sequence
  Synthetic Oligonucleotide
cgtgaggaagctcattttca

SEQ ID NO: 149 - DNA, 20 bp, Artificial sequence
  Synthetic Oligonucleotide
gttttggacaaccttccact

SEQ ID NO: 150 - DNA, 20 bp, Artificial sequence
  Synthetic Oligonucleotide
tctggaatttttctaggagc

SEQ ID NO: 151 - DNA, 20 bp, Artificial sequence
  Synthetic Oligonucleotide
tgcttggaaccagcaaatat

SEQ ID NO: 152 - DNA, 20 bp, Artificial sequence
  Synthetic Oligonucleotide
gtggtccacaacttggccca

SEQ ID NO: 153 - DNA, 20 bp, Artificial sequence
  Synthetic Oligonucleotide
tggagcttgttcaaattcca

SEQ ID NO: 154 - DNA, 20 bp, Artificial sequence
  Synthetic Oligonucleotide
ggtggaggtggcaaagcacc

SEQ ID NO: 155 - DNA, 20 bp, Artificial sequence
  Synthetic Oligonucleotide
ccaaggaacccttggaggct

SEQ ID NO: 156 - DNA, 20 bp, Artificial sequence
  Synthetic Oligonucleotide
cctgctgaagcaggcgatcc

SEQ ID NO: 157 - DNA, 20 bp, Artificial sequence
  Synthetic Oligonucleotide
tttgtcctgctgaagcaggc

SEQ ID NO: 158 - DNA, 20 bp, Artificial sequence
  Synthetic Oligonucleotide
ggaggtatctcaaaccatca

SEQ ID NO: 159 - DNA, 20 bp, Artificial sequence
  Synthetic Oligonucleotide
gcaatctttgcaatgatggc

SEQ ID NO: 160 - DNA, 20 bp, Artificial sequence
  Synthetic Oligonucleotide
cgtagtcagcaatctttgca

SEQ ID NO: 161 - DNA, 20 bp, Artificial sequence
  Synthetic Oligonucleotide
tgatgtgtagcaaccatgca

SEQ ID NO: 162 - DNA, 20 bp, Artificial sequence
  Synthetic Oligonucleotide
tgttgtgatgtgtagcaacc

SEQ ID NO: 163 - DNA, 20 bp, Artificial sequence
  Synthetic Oligonucleotide
agcccagccaaatgcttgca

SEQ ID NO: 164 - DNA, 20 bp, Artificial sequence
  Synthetic Oligonucleotide
ggtgtgcccacagcccagcc

SEQ ID NO: 165 - DNA, 20 bp, Artificial sequence
  Synthetic Oligonucleotide
tcagaagtgtatccttcagt

SEQ ID NO: 166 - DNA, 20 bp, Artificial sequence
  Synthetic Oligonucleotide
gcagtgttcttctgaaggca

SEQ ID NO: 167 - DNA, 20 bp, Artificial sequence
  Synthetic Oligonucleotide
tgtcatcatgactctgaccg

SEQ ID NO: 168 - DNA, 20 bp, Artificial sequence
  Synthetic Oligonucleotide
aggactttgacagtatgtca

SEQ ID NO: 169 - DNA, 20 bp, Artificial sequence
  Synthetic Oligonucleotide
tccttcagcaactgaaaagt

SEQ ID NO: 170 - DNA, 20 bp, Artificial sequence
  Synthetic Oligonucleotide
tggaagcctagggtggcaga

SEQ ID NO: 171 - DNA, 20 bp, Artificial sequence
  Synthetic Oligonucleotide
agttgtcctatcacagggaa

SEQ ID NO: 172 - DNA, 20 bp, Artificial sequence
  Synthetic Oligonucleotide
atcagattcccctgaggtac

SEQ ID NO: 173 - DNA, 20 bp, Artificial sequence
  Synthetic Oligonucleotide
cagtctgaatcagattcccc

SEQ ID NO: 174 - DNA, 20 bp, Artificial sequence
  Synthetic Oligonucleotide
gttcagctgcagtaatctgc

SEQ ID NO: 175 - DNA, 20 bp, Artificial sequence
  Synthetic Oligonucleotide
actgagtgttcagctgcagt

SEQ ID NO: 176 - DNA, 20 bp, Artificial sequence
  Synthetic Oligonucleotide
cccaaactgagtgttcagct

SEQ ID NO: 177 - DNA, 20 bp, Artificial sequence
  Synthetic Oligonucleotide
acttactggtgaacaccaag

SEQ ID NO: 178 - DNA, 20 bp, Artificial sequence
  Synthetic Oligonucleotide
atgagctgggaaactttcaa

SEQ ID NO: 179 - DNA, 20 bp, Artificial sequence
  Synthetic Oligonucleotide
tctggcatgcctaaatgcac

SEQ ID NO: 180 - DNA, 20 bp, Artificial sequence
  Synthetic Oligonucleotide
ttgtactgaccttggtcatc

SEQ ID NO: 181 - DNA, 20 bp, Artificial sequence
  Synthetic Oligonucleotide
tcttcagagtctgaaaagac

SEQ ID NO: 182 - DNA, 20 bp, Artificial sequence
  Synthetic Oligonucleotide
aagcgcgagcctggagggaa

SEQ ID NO: 183 - DNA, 20 bp, Artificial sequence
  Synthetic Oligonucleotide
tggaggtatctgccagaaaa

SEQ ID NO: 184 - DNA, 20 bp, Artificial sequence
  Synthetic Oligonucleotide
atcacctacctggtgtgccc

SEQ ID NO: 185 - DNA, 20 bp, Artificial sequence
  Synthetic Oligonucleotide
tgggactgctctctttctca

SEQ ID NO: 186 - DNA, 20 bp, Artificial sequence
  Synthetic Oligonucleotide
atttgggactgctctctttc

SEQ ID NO: 187 - DNA, 20 bp, Artificial sequence
  Synthetic Oligonucleotide
ttcacgagatccactattca

SEQ ID NO: 188 - DNA, 20 bp, Artificial sequence
  Synthetic Oligonucleotide
gtcacctttcccaatgctta

SEQ ID NO: 189 - DNA, 20 bp, Artificial sequence
  Synthetic Oligonucleotide
ggccacatccagggccagcc

SEQ ID NO: 190 - DNA, 20 bp, Artificial sequence
  Synthetic Oligonucleotide
tcaacttttcctatacaaaa

SEQ ID NO: 191 - DNA, 20 bp, Artificial sequence
  Synthetic Oligonucleotide
ataaaggaccaagccaagaa

SEQ ID NO: 192 - DNA, 20 bp, Artificial sequence
  Synthetic Oligonucleotide
gaaataaaggaccaagccaa

SEQ ID NO: 193 - DNA, 20 bp, Artificial sequence
  Synthetic Oligonucleotide
tctggaaataaaggaccaag

SEQ ID NO: 194 - DNA, 20 bp, Artificial sequence
  Synthetic Oligonucleotide
ttatctggaaataaaggacc

SEQ ID NO: 195 - DNA, 20 bp, Artificial sequence
  Synthetic Oligonucleotide
aattagaagtcttatctgga

SEQ ID NO: 196 - DNA, 20 bp, Artificial sequence
  Synthetic Oligonucleotide
tcaccattcttgctagtgta

SEQ ID NO: 197 - DNA, 20 bp, Artificial sequence
  Synthetic Oligonucleotide
cctgaggctgttccttcttc

SEQ ID NO: 198 - DNA, 20 bp, Artificial sequence
  Synthetic Oligonucleotide
catcaaatttagacagcaca

SEQ ID NO: 199 - DNA, 20 bp, Artificial sequence
  Synthetic Oligonucleotide
aacacactgtccatagaaga

SEQ ID NO: 200 - DNA, 20 bp, Artificial sequence
  Synthetic Oligonucleotide
agcaaacacactgtccatag

SEQ ID NO: 201 - DNA, 20 bp, Artificial sequence
  Synthetic Oligonucleotide
ttgagcaaacacactgtcca

SEQ ID NO: 202 - DNA, 20 bp, Artificial sequence
  Synthetic Oligonucleotide
agaaatgagccttcacttcc

SEQ ID NO: 203 - DNA, 20 bp, Artificial sequence
  Synthetic Oligonucleotide
ggtaaaattctcctacacta

SEQ ID NO: 204 - DNA, 20 bp, Artificial sequence
  Synthetic Oligonucleotide
atgtctttgcaaatttggtg

SEQ ID NO: 205 - DNA, 20 bp, Artificial sequence
  Synthetic Oligonucleotide
ttcagtaaatcttcatgatc

SEQ ID NO: 206 - DNA, 20 bp, Artificial sequence
  Synthetic Oligonucleotide
atgacctgagtgaatcatct

SEQ ID NO: 207 - DNA, 20 bp, Artificial sequence
  Synthetic Oligonucleotide
gagaagaaatgctgtctgaa

SEQ ID NO: 208 - DNA, 20 bp, Artificial sequence
  Synthetic Oligonucleotide
tgctgaaaggtctagtgatg

SEQ ID NO: 209 - DNA, 20 bp, Artificial sequence
  Synthetic Oligonucleotide
tatacagcatttctggctta

SEQ ID NO: 210 - DNA, 20 bp, Artificial sequence
  Synthetic Oligonucleotide
ttctggtgaagctccagctt

SEQ ID NO: 211 - DNA, 20 bp, Artificial sequence
  Synthetic Oligonucleotide
tcttcagagtttcacatagc

SEQ ID NO: 212 - DNA, 20 bp, Artificial sequence
  Synthetic Oligonucleotide
aaggaaatgatgtaaattta

SEQ ID NO: 213 - DNA, 20 bp, Artificial sequence
  Synthetic Oligonucleotide
agagacatcaagattagcaa

SEQ ID NO: 214 - DNA, 20 bp, Artificial sequence
  Synthetic Oligonucleotide
ttcactgtaggatctaaaac

SEQ ID NO: 215 - DNA, 20 bp, Artificial sequence
  Synthetic Oligonucleotide
gacagctggttatatgacag

SEQ ID NO: 216 - DNA, 20 bp, Artificial sequence
  Synthetic Oligonucleotide
gctccagtttctctaccaca

SEQ ID NO: 217 - DNA, 20 bp, Artificial sequence
  Synthetic Oligonucleotide
agttccttcagtctcaaggg

SEQ ID NO: 218 - DNA, 20 bp, Artificial sequence
  Synthetic Oligonucleotide
ctgatagggatgaaatgtgg

SEQ ID NO: 219 - DNA, 20 bp, Artificial sequence
  Synthetic Oligonucleotide
ggcactgaaactctccactt

SEQ ID NO: 220 - DNA, 20 bp, Artificial sequence
  Synthetic Oligonucleotide
atagaaggaggcaagaaagg

SEQ ID NO: 221 - DNA, 20 bp, Artificial sequence
  Synthetic Oligonucleotide
ctggaatacaggaaaatttg

SEQ ID NO: 222 - DNA, 20 bp, Artificial sequence
  Synthetic Oligonucleotide
gctcatatctaaagaccgca

SEQ ID NO: 223 - DNA, 20 bp, Artificial sequence
  Synthetic Oligonucleotide
gatttccagtgtgcgggacc

SEQ ID NO: 224 - DNA, 20 bp, Artificial sequence
  Synthetic Oligonucleotide
tgctgatctgattatggcta

SEQ ID NO: 225 - DNA, 20 bp, Artificial sequence
  Synthetic Oligonucleotide
ctctactctagaccataaat

SEQ ID NO: 226 - DNA, 20 bp, Artificial sequence
  Synthetic Oligonucleotide
ctcaggaggaatctctttca

SEQ ID NO: 227 - DNA, 20 bp, Artificial sequence
  Synthetic Oligonucleotide
ttgtaactgacatccagaga

SEQ ID NO: 228 - DNA, 20 bp, Artificial sequence
  Synthetic Oligonucleotide
tgcttaatttccccatttca

SEQ ID NO: 229 - DNA, 20 bp, Artificial sequence
  Synthetic Oligonucleotide
atcaaagttaagatgcagtt

SEQ ID NO: 230 - DNA, 20 bp, Artificial sequence
  Synthetic Oligonucleotide
tatgatgtctttggctttac

SEQ ID NO: 231 - DNA, 20 bp, Artificial sequence
  Synthetic Oligonucleotide
ccttatgatgtctttggctt

SEQ ID NO: 232 - DNA, 20 bp, Artificial sequence
  Synthetic Oligonucleotide
gaaaccttatgatgtctttg

SEQ ID NO: 233 - DNA, 20 bp, Artificial sequence
  Synthetic Oligonucleotide
agaaaccttatgatgtcttt

SEQ ID NO: 234 - DNA, 20 bp, Artificial sequence
  Synthetic Oligonucleotide
gaagaaaccttatgatgtct

SEQ ID NO: 235 - DNA, 20 bp, Artificial sequence
  Synthetic Oligonucleotide
gtttcattcggttataaggc

SEQ ID NO: 236 - DNA, 20 bp, Artificial sequence
  Synthetic Oligonucleotide
caataaggtggttttaccac

SEQ ID NO: 237 - DNA, 20 bp, Artificial sequence
  Synthetic Oligonucleotide
ctttgcattccaagatctga

SEQ ID NO: 238 - DNA, 20 bp, Artificial sequence
  Synthetic Oligonucleotide
ttatttggataggccagtct

SEQ ID NO: 239 - DNA, 20 bp, Artificial sequence
  Synthetic Oligonucleotide
aaaatcccacacatttagga

SEQ ID NO: 240 - DNA, 20 bp, Artificial sequence
  Synthetic Oligonucleotide
aaggtacaatgctcgctgcg

SEQ ID NO: 241 - DNA, 20 bp, Artificial sequence
  Synthetic Oligonucleotide
atggcatcaacttcagcctg

SEQ ID NO: 242 - DNA, 20 bp, Artificial sequence
  Synthetic Oligonucleotide
gggaagaagaagcgcgagcc

SEQ ID NO: 243 - DNA, 20 bp, Artificial sequence
  Synthetic Oligonucleotide
gcttctcatcagaaacatcc

SEQ ID NO: 244 - DNA, 20 bp, Artificial sequence
  Synthetic Oligonucleotide
attcaggagttccttggtga

SEQ ID NO: 245 - DNA, 20 bp, Artificial sequence
  Synthetic Oligonucleotide
gcattcacaaagtggtaatc

SEQ ID NO: 246 - DNA, 20 bp, Artificial sequence
  Synthetic Oligonucleotide
tgatggttttccgaagtttt

SEQ ID NO: 247 - DNA, 20 bp, Artificial sequence
  Synthetic Oligonucleotide
aacaacaagctgatctcgga

SEQ ID NO: 248 - DNA, 20 bp, Artificial sequence
  Synthetic Oligonucleotide
atgattttttcaagttctac

SEQ ID NO: 249 - DNA, 20 bp, Artificial sequence
  Synthetic Oligonucleotide
caattacgggaaattcaatt

SEQ ID NO: 250 - DNA, 20 bp, Artificial sequence
  Synthetic Oligonucleotide
ctgcagctgattttctctca

SEQ ID NO: 251 - DNA, 20 bp, Artificial sequence
  Synthetic Oligonucleotide
tcatttagaaagtgaactgc

SEQ ID NO: 252 - DNA, 20 bp, Artificial sequence
  Synthetic Oligonucleotide
tcacttaactgcagtgctgg

SEQ ID NO: 253 - DNA, 20 bp, Artificial sequence
  Synthetic Oligonucleotide
tgggttccacaaagtacaag

SEQ ID NO: 254 - DNA, 20 bp, Artificial sequence
  Synthetic Oligonucleotide
acttgggttccacaaagtac

SEQ ID NO: 255 - DNA, 20 bp, Artificial sequence
  Synthetic Oligonucleotide
agccacttgggttccacaaa

SEQ ID NO: 256 - DNA, 20 bp, Artificial sequence
  Synthetic Oligonucleotide
caaagccacttgggttccac

SEQ ID NO: 257 - DNA, 20 bp, Artificial sequence
  Synthetic Oligonucleotide
tgctctctttctcacatacc

SEQ ID NO: 258 - DNA, 20 bp, Artificial sequence
  Synthetic Oligonucleotide
ctgctctctttctcacatac

SEQ ID NO: 259 - DNA, 20 bp, Artificial sequence
  Synthetic Oligonucleotide
actgctctctttctcacata

SEQ ID NO: 260 - DNA, 20 bp, Artificial sequence
  Synthetic Oligonucleotide
tcaccgcccgcagccagcgc

SEQ ID NO: 261 - DNA, 20 bp, Artificial sequence
  Synthetic Oligonucleotide
ctgctcagggaaccggcagg

SEQ ID NO: 262 - DNA, 20 bp, Artificial sequence
  Synthetic Oligonucleotide
tggcacctgcttccaacccg

SEQ ID NO: 263 - DNA, 20 bp, Artificial sequence
  Synthetic Oligonucleotide
acttcttcagagtttcctcg

SEQ ID NO: 264 - DNA, 20 bp, Artificial sequence
  Synthetic Oligonucleotide
tgactatcaacttcttcaga

SEQ ID NO: 265 - DNA, 20 bp, Artificial sequence
  Synthetic Oligonucleotide
gcctgactatcaacttcttc

SEQ ID NO: 266 - DNA, 20 bp, Artificial sequence
  Synthetic Oligonucleotide
ttcagcctgactatcaactt

SEQ ID NO: 267 - DNA, 20 bp, Artificial sequence
  Synthetic Oligonucleotide
ttgttcagcctgactatcaa

SEQ ID NO: 268 - DNA, 20 bp, Artificial sequence
  Synthetic Oligonucleotide
gtttctatctgttttccttc

SEQ ID NO: 269 - DNA, 20 bp, Artificial sequence
  Synthetic Oligonucleotide
cttgaaataacttggaggcg

SEQ ID NO: 270 - DNA, 20 bp, Artificial sequence
  Synthetic Oligonucleotide
ataggagtccaagacgatca

SEQ ID NO: 271 - DNA, 20 bp, Artificial sequence
  Synthetic Oligonucleotide
ttgcacagaagtgaccaacc

SEQ ID NO: 272 - DNA, 20 bp, Artificial sequence
  Synthetic Oligonucleotide
gtcccattaagctttgcatt

SEQ ID NO: 273 - DNA, 20 bp, Artificial sequence
  Synthetic Oligonucleotide
attggtgaacaccaaggact

SEQ ID NO: 274 - DNA, 20 bp, Artificial sequence
  Synthetic Oligonucleotide
caagtttacactggcattat

SEQ ID NO: 275 - DNA, 20 bp, Artificial sequence
  Synthetic Oligonucleotide
cctgaagttaggaggagatc

SEQ ID NO: 276 - DNA, 20 bp, Artificial sequence
  Synthetic Oligonucleotide
catgaaaatatcactttctt

SEQ ID NO: 277 - DNA, 20 bp, Artificial sequence
  Synthetic Oligonucleotide
tggcatcaaaaattaacatg

SEQ ID NO: 278 - DNA, 20 bp, Artificial sequence
  Synthetic Oligonucleotide
gcatggcatcaaaaattaac

SEQ ID NO: 279 - DNA, 20 bp, Artificial sequence
  Synthetic Oligonucleotide
gagtgcatggcatcaaaaat

SEQ ID NO: 280 - DNA, 20 bp, Artificial sequence
  Synthetic Oligonucleotide
aatgagtgcatggcatcaaa

SEQ ID NO: 281 - DNA, 20 bp, Artificial sequence
  Synthetic Oligonucleotide
acttcatcattggctggaaa

SEQ ID NO: 282 - DNA, 20 bp, Artificial sequence
  Synthetic Oligonucleotide
ctctctcaaacagcacatgt

SEQ ID NO: 283 - DNA, 20 bp, Artificial sequence
  Synthetic Oligonucleotide
ataatctttgttctcaacaa

SEQ ID NO: 284 - DNA, 20 bp, Artificial sequence
  Synthetic Oligonucleotide
atttcctcttcatctttaaa

SEQ ID NO: 285 - DNA, 20 bp, Artificial sequence
  Synthetic Oligonucleotide
aaggaatcgctagggaatgt

SEQ ID NO: 286 - DNA, 20 bp, Artificial sequence
  Synthetic Oligonucleotide
ataacacctgacattgccac

SEQ ID NO: 287 - DNA, 20 bp, Artificial sequence
  Synthetic Oligonucleotide
gctttcatagcttccaccac

SEQ ID NO: 288 - DNA, 20 bp, Artificial sequence
  Synthetic Oligonucleotide
aatgctttcatagcttccac

SEQ ID NO: 289 - DNA, 20 bp, Artificial sequence
  Synthetic Oligonucleotide
agggaatgctttcatagctt

SEQ ID NO: 290 - DNA, 20 bp, Artificial sequence
  Synthetic Oligonucleotide
catagggaatgctttcatag

SEQ ID NO: 291 - DNA, 20 bp, Artificial sequence
  Synthetic Oligonucleotide
ctttcactcatagggaatgc

SEQ ID NO: 292 - DNA, 20 bp, Artificial sequence
  Synthetic Oligonucleotide
ctaatgtaagcctatggagc

SEQ ID NO: 293 - DNA, 20 bp, Artificial sequence
  Synthetic Oligonucleotide
ccacaaactcatggacttcg

SEQ ID NO: 294 - DNA, 20 bp, Artificial sequence
  Synthetic Oligonucleotide
gatctgcaatgctgcattct

SEQ ID NO: 295 - DNA, 20 bp, Artificial sequence
  Synthetic Oligonucleotide
catcatcattctcttgattc

SEQ ID NO: 296 - DNA, 20 bp, Artificial sequence
  Synthetic Oligonucleotide
tttgtaacaggcttccagcc

SEQ ID NO: 297 - DNA, 20 bp, Artificial sequence
  Synthetic Oligonucleotide
agcatgcggcctcctgcacg

SEQ ID NO: 298 - DNA, 20 bp, Artificial sequence
  Synthetic Oligonucleotide
ctcatgtaaactgttttggt

SEQ ID NO: 299 - DNA, 20 bp, Artificial sequence
  Synthetic Oligonucleotide
acttccctatgagctgggaa

SEQ ID NO: 300 - DNA, 20 bp, Artificial sequence
  Synthetic Oligonucleotide
ggaaaacttcctttgatgaa

SEQ ID NO: 301 - DNA, 20 bp, Artificial sequence
  Synthetic Oligonucleotide
ttgataacagtatttttctg

SEQ ID NO: 302 - DNA, 20 bp, Artificial sequence
  Synthetic Oligonucleotide
tatatgcttctgcattaact

SEQ ID NO: 303 - DNA, 20 bp, Artificial sequence
  Synthetic Oligonucleotide
tgatttagcattttacagcc

SEQ ID NO: 304 - DNA, 20 bp, Artificial sequence
  Synthetic Oligonucleotide
ctgctgccattatatccagg

SEQ ID NO: 305 - DNA, 20 bp, Artificial sequence
  Synthetic Oligonucleotide
ggtaatgatgtctcatgacg

SEQ ID NO: 306 - DNA, 20 bp, Artificial sequence
  Synthetic Oligonucleotide
caggcactataaaatgtaaa

SEQ ID NO: 307 - DNA, 20 bp, Artificial sequence
  Synthetic Oligonucleotide
cttatgatgaaattctgtat

SEQ ID NO: 308 - DNA, 20 bp, Artificial sequence
  Synthetic Oligonucleotide
tttgtgaatatcattcttga

SEQ ID NO: 309 - DNA, 20 bp, Artificial sequence
  Synthetic Oligonucleotide
aatcccaggatttccaatga

SEQ ID NO: 310 - DNA, 20 bp, Artificial sequence
  Synthetic Oligonucleotide
atttctgaatcccaggattt

SEQ ID NO: 311 - DNA, 20 bp, Artificial sequence
  Synthetic Oligonucleotide
cacatttctgaatcccagga

SEQ ID NO: 312 - DNA, 20 bp, Artificial sequence
  Synthetic Oligonucleotide
aatccacatttctgaatccc

SEQ ID NO: 313 - DNA, 20 bp, Artificial sequence
  Synthetic Oligonucleotide
tttaatccacatttctgaat

SEQ ID NO: 314 - DNA, 20 bp, Artificial sequence
  Synthetic Oligonucleotide
tcaggaaaatgtacaataga

SEQ ID NO: 315 - DNA, 20 bp, Artificial sequence
  Synthetic Oligonucleotide
gaagcactgaatccatagca

SEQ ID NO: 316 - DNA, 20 bp, Artificial sequence
  Synthetic Oligonucleotide
tgaacacattcttctttgta

SEQ ID NO: 317 - DNA, 20 bp, Artificial sequence
  Synthetic Oligonucleotide
tataagctggaaaccagaat

SEQ ID NO: 318 - DNA, 20 bp, Artificial sequence
  Synthetic Oligonucleotide
tctgaaatcctttagtctgt

SEQ ID NO: 319 - DNA, 20 bp, Artificial sequence
  Synthetic Oligonucleotide
cagcttagaaaaagatgctg

SEQ ID NO: 320 - DNA, 20 bp, Artificial sequence
  Synthetic Oligonucleotide
gacatttgatggaatattac

SEQ ID NO: 321 - DNA, 20 bp, Artificial sequence
  Synthetic Oligonucleotide
agaggtttagaaactgttga

SEQ ID NO: 322 - DNA, 20 bp, Artificial sequence
  Synthetic Oligonucleotide
ttttaagtaatcatccatag

SEQ ID NO: 323 - DNA, 20 bp, Artificial sequence
  Synthetic Oligonucleotide
atgatgctgttattctgatc

SEQ ID NO: 324 - DNA, 20 bp, Artificial sequence
  Synthetic Oligonucleotide
ttgcttgattggcatctgct

SEQ ID NO: 325 - DNA, 20 bp, Artificial sequence
  Synthetic Oligonucleotide
ctttctcacatacctgacaa

SEQ ID NO: 326 - DNA, 20 bp, Artificial sequence
  Synthetic Oligonucleotide
tctctttctcacatacctga

SEQ ID NO: 327 - DNA, 20 bp, Artificial sequence
  Synthetic Oligonucleotide
ctgtgccatgattttacaaa

SEQ ID NO: 328 - DNA, 20 bp, Artificial sequence
  Synthetic Oligonucleotide
cccttagggtgttttggaca

SEQ ID NO: 329 - DNA, 20 bp, Artificial sequence
  Synthetic Oligonucleotide
ccttttttttgaaagaaatt

SEQ ID NO: 330 - DNA, 20 bp, Artificial sequence
  Synthetic Oligonucleotide
tctaggagcttaaaatactg

SEQ ID NO: 331 - DNA, 20 bp, Artificial sequence
  Synthetic Oligonucleotide
aaccagcaaatattcttctc

SEQ ID NO: 332 - DNA, 20 bp, Artificial sequence
  Synthetic Oligonucleotide
ttcagagttctcacaatggg

SEQ ID NO: 333 - DNA, 20 bp, Artificial sequence
  Synthetic Oligonucleotide
ccaaaatcccattggaaaat

SEQ ID NO: 334 - DNA, 20 bp, Artificial sequence
  Synthetic Oligonucleotide
agcatgtaaggtgaaatctc

SEQ ID NO: 335 - DNA, 20 bp, Artificial sequence
  Synthetic Oligonucleotide
gccaatacattctgtttggg

SEQ ID NO: 336 - DNA, 20 bp, Artificial sequence
  Synthetic Oligonucleotide
cagacaataagcttcaggag

SEQ ID NO: 337 - DNA, 20 bp, Artificial sequence
  Synthetic Oligonucleotide
atttttaagaaactctctgg

SEQ ID NO: 338 - DNA, 20 bp, Artificial sequence
  Synthetic Oligonucleotide
cttggcccaaaagaatacag

SEQ ID NO: 339 - DNA, 20 bp, Artificial sequence
  Synthetic Oligonucleotide
gcaacccaggaaaccattct

SEQ ID NO: 340 - DNA, 20 bp, Artificial sequence
  Synthetic Oligonucleotide
tttcttcaacagagtttctc

SEQ ID NO: 341 - DNA, 20 bp, Artificial sequence
  Synthetic Oligonucleotide
ccatttcttcaacagagttt

SEQ ID NO: 342 - DNA, 20 bp, Artificial sequence
  Synthetic Oligonucleotide
atgcccatttcttcaacaga

SEQ ID NO: 343 - DNA, 20 bp, Artificial sequence
  Synthetic Oligonucleotide
ataatgcccatttcttcaac

SEQ ID NO: 344 - DNA, 20 bp, Artificial sequence
  Synthetic Oligonucleotide
gattttttgatgttcttcac

SEQ ID NO: 345 - DNA, 20 bp, Artificial sequence
  Synthetic Oligonucleotide
taagagatctccttcctctg

SEQ ID NO: 346 - DNA, 20 bp, Artificial sequence
  Synthetic Oligonucleotide
atctgagatattggaatggt

SEQ ID NO: 347 - DNA, 20 bp, Artificial sequence
  Synthetic Oligonucleotide
acataatatttctaggcagg

SEQ ID NO: 348 - DNA, 20 bp, Artificial sequence
  Synthetic Oligonucleotide
gagaaactctggagcttgtt

SEQ ID NO: 349 - DNA, 20 bp, Artificial sequence
  Synthetic Oligonucleotide
tcataggctgctcggtaaac

SEQ ID NO: 350 - DNA, 20 bp, Artificial sequence
  Synthetic Oligonucleotide
gtgatgtatgtttattaaaa

SEQ ID NO: 351 - DNA, 20 bp, Artificial sequence
  Synthetic Oligonucleotide
gtggaggtggcaaagcacca

SEQ ID NO: 352 - DNA, 20 bp, Artificial sequence
  Synthetic Oligonucleotide
ctccatcaccaacatccggg

SEQ ID NO: 353 - DNA, 20 bp, Artificial sequence
  Synthetic Oligonucleotide
ttgtcctgctgaagcaggcg

SEQ ID NO: 354 - DNA, 20 bp, Artificial sequence
  Synthetic Oligonucleotide
cgtggagtgcaatcctgtgc

SEQ ID NO: 355 - DNA, 20 bp, Artificial sequence
  Synthetic Oligonucleotide
gtatataatcatggctgagt

SEQ ID NO: 356 - DNA, 20 bp, Artificial sequence
  Synthetic Oligonucleotide
ggatacagtgtgaaaagcag

SEQ ID NO: 357 - DNA, 20 bp, Artificial sequence
  Synthetic Oligonucleotide
gagcaatgccgtagtcagca

SEQ ID NO: 358 - DNA, 20 bp, Artificial sequence
  Synthetic Oligonucleotide
tactgagcaatgccgtagtc

SEQ ID NO: 359 - DNA, 20 bp, Artificial sequence
  Synthetic Oligonucleotide
cagtactgagcaatgccgta

SEQ ID NO: 360 - DNA, 20 bp, Artificial sequence
  Synthetic Oligonucleotide
agcagtactgagcaatgccg

SEQ ID NO: 361 - DNA, 20 bp, Artificial sequence
  Synthetic Oligonucleotide
acagcagtactgagcaatgc

SEQ ID NO: 362 - DNA, 20 bp, Artificial sequence
  Synthetic Oligonucleotide
tctacagcagtactgagcaa

SEQ ID NO: 363 - DNA, 20 bp, Artificial sequence
  Synthetic Oligonucleotide
ctggtgtgccctctgatgtt

SEQ ID NO: 364 - DNA, 20 bp, Artificial sequence
  Synthetic Oligonucleotide
gttataaatgacatttcctc

SEQ ID NO: 365 - DNA, 20 bp, Artificial sequence
  Synthetic Oligonucleotide
atgtcatagagtagtaaacc

SEQ ID NO: 366 - DNA, 20 bp, Artificial sequence
  Synthetic Oligonucleotide
atttggaaacttcaaaccct

SEQ ID NO: 367 - DNA, 20 bp, Artificial sequence
  Synthetic Oligonucleotide
actggatcaggtaattttcc

SEQ ID NO: 368 - DNA, 20 bp, Artificial sequence
  Synthetic Oligonucleotide
ttaatttctcaaccataggc

SEQ ID NO: 369 - DNA, 20 bp, Artificial sequence
  Synthetic Oligonucleotide
agaagtaggcctttcttgag

SEQ ID NO: 370 - DNA, 20 bp, Artificial sequence
  Synthetic Oligonucleotide
agacagactaattcagctga

SEQ ID NO: 371 - DNA, 20 bp, Artificial sequence
  Synthetic Oligonucleotide
ccatgcattcaacaattacg

SEQ ID NO: 372 - DNA, 20 bp, Artificial sequence
  Synthetic Oligonucleotide
gcccagccaaatgcttgcat

SEQ ID NO: 373 - DNA, 20 bp, Artificial sequence
  Synthetic Oligonucleotide
tttaagtcaagaaatgagag

SEQ ID NO: 374 - DNA, 20 bp, Artificial sequence
  Synthetic Oligonucleotide
atattctactatcagcaact

SEQ ID NO: 375 - DNA, 20 bp, Artificial sequence
  Synthetic Oligonucleotide
ccagctttccttttcaacag

SEQ ID NO: 376 - DNA, 20 bp, Artificial sequence
  Synthetic Oligonucleotide
gtattgatgaccaggagagt

SEQ ID NO: 377 - DNA, 20 bp, Artificial sequence
  Synthetic Oligonucleotide
aatcagtcatcttttctagg

SEQ ID NO: 378 - DNA, 20 bp, Artificial sequence
  Synthetic Oligonucleotide
tttgctttgcttggaaaagg

SEQ ID NO: 379 - DNA, 20 bp, Artificial sequence
  Synthetic Oligonucleotide
gctaacttgccatcagcggt

SEQ ID NO: 380 - DNA, 20 bp, Artificial sequence
  Synthetic Oligonucleotide
aaggagcagctcctttaagc

SEQ ID NO: 381 - DNA, 20 bp, Artificial sequence
  Synthetic Oligonucleotide
acacatcaatggagtactga

SEQ ID NO: 382 - DNA, 20 bp, Artificial sequence
  Synthetic Oligonucleotide
ccccacattacatttctttc

SEQ ID NO: 383 - DNA, 20 bp, Artificial sequence
  Synthetic Oligonucleotide
tggtgaaatcattagaaaag

SEQ ID NO: 384 - DNA, 20 bp, Artificial sequence
  Synthetic Oligonucleotide
cataagaaaacagttggctt

SEQ ID NO: 385 - DNA, 20 bp, Artificial sequence
  Synthetic Oligonucleotide
agtgtctaccaccactgtta

SEQ ID NO: 386 - DNA, 20 bp, Artificial sequence
  Synthetic Oligonucleotide
cacacttccacaacagggct

SEQ ID NO: 387 - DNA, 20 bp, Artificial sequence
  Synthetic Oligonucleotide
gcacgcagtctattagtcca

SEQ ID NO: 388 - DNA, 20 bp, Artificial sequence
  Synthetic Oligonucleotide
gttttgattccttgttttct

SEQ ID NO: 389 - DNA, 20 bp, Artificial sequence
  Synthetic Oligonucleotide
ctgaaggcagagggttttca

SEQ ID NO: 390 - DNA, 20 bp, Artificial sequence
  Synthetic Oligonucleotide
aaaatatggcctcctccagt

SEQ ID NO: 391 - DNA, 20 bp, Artificial sequence
  Synthetic Oligonucleotide
caaaagttgtaaattacacg

SEQ ID NO: 392 - DNA, 20 bp, Artificial sequence
  Synthetic Oligonucleotide
taaggcttcctagctgtgct

SEQ ID NO: 393 - DNA, 20 bp, Artificial sequence
  Synthetic Oligonucleotide
ttcagtatttttccggttgt

SEQ ID NO: 394 - DNA, 20 bp, Artificial sequence
  Synthetic Oligonucleotide
caaacggtcaagcaagattg

SEQ ID NO: 395 - DNA, 20 bp, Artificial sequence
  Synthetic Oligonucleotide
caatgtgtttttctaaattt

SEQ ID NO: 396 - DNA, 20 bp, Artificial sequence
  Synthetic Oligonucleotide
tcttactcaacagatgttcg

SEQ ID NO: 397 - DNA, 20 bp, Artificial sequence
  Synthetic Oligonucleotide
gaggagagaataattttcct

SEQ ID NO: 398 - DNA, 20 bp, Artificial sequence
  Synthetic Oligonucleotide
gagtaccctttccatgtgaa

SEQ ID NO: 399 - DNA, 20 bp, Artificial sequence
  Synthetic Oligonucleotide
aaaataataacattccttca

SEQ ID NO: 400 - DNA, 20 bp, Artificial sequence
  Synthetic Oligonucleotide
aaaatacacatttactggta

SEQ ID NO: 401 - DNA, 20 bp, Artificial sequence
  Synthetic Oligonucleotide
ctggtatttataagaaatat

SEQ ID NO: 402 - DNA, 20 bp, Artificial sequence
  Synthetic Oligonucleotide
attaggtacttcacagattt

SEQ ID NO: 403 - DNA, 20 bp, Artificial sequence
  Synthetic Oligonucleotide
aacaaaaaattatcggcctt

SEQ ID NO: 404 - DNA, 20 bp, Artificial sequence
  Synthetic Oligonucleotide
cttaagcacagaatttaaaa

SEQ ID NO: 405 - DNA, 20 bp, Artificial sequence
  Synthetic Oligonucleotide
ataccgtgcagatttctaga

SEQ ID NO: 406 - DNA, 20 bp, Artificial sequence
  Synthetic Oligonucleotide
aagaaggaatacattacatg

SEQ ID NO: 407 - DNA, 20 bp, Artificial sequence
  Synthetic Oligonucleotide
tttgaatatttacaagcata

SEQ ID NO: 408 - DNA, 20 bp, Artificial sequence
  Synthetic Oligonucleotide
attagtgcaaattcatttga

SEQ ID NO: 409 - DNA, 20 bp, Artificial sequence
  Synthetic Oligonucleotide
actttattagtgcaaattca

SEQ ID NO: 410 - DNA, 20 bp, Artificial sequence
  Synthetic Oligonucleotide
aaaggactttattagtgcaa

SEQ ID NO: 411 - DNA, 20 bp, Artificial sequence
  Synthetic Oligonucleotide
ccaacaaaggactttattag

SEQ ID NO: 412 - DNA, 20 bp, Artificial sequence
  Synthetic Oligonucleotide
acataccaacaaaggacttt

SEQ ID NO: 413 - DNA, 20 bp, Artificial sequence
  Synthetic Oligonucleotide
aagagaattcacataccaac

SEQ ID NO: 414 - DNA, 20 bp, Artificial sequence
  Synthetic Oligonucleotide
aattgagtgaagttgtgtaa

SEQ ID NO: 415 - DNA, 20 bp, Artificial sequence
  Synthetic Oligonucleotide
atgtcatgttttttcattag

SEQ ID NO: 416 - DNA, 20 bp, Artificial sequence
  Synthetic Oligonucleotide
aaagagagtttctgtgtctt

SEQ ID NO: 417 - DNA, 20 bp, Artificial sequence
  Synthetic Oligonucleotide
acaactctattatgtctagg

SEQ ID NO: 418 - DNA, 20 bp, Artificial sequence
  Synthetic Oligonucleotide
tatacaaaattcagggtatc

SEQ ID NO: 419 - DNA, 20 bp, Artificial sequence
  Synthetic Oligonucleotide
tagtggtatgaataaaaaaa

SEQ ID NO: 420 - DNA, 20 bp, Artificial sequence
  Synthetic Oligonucleotide
agatgaatataagcattaga

SEQ ID NO: 421 - DNA, 20 bp, Artificial sequence
  Synthetic Oligonucleotide
tatctgaatgatgtaggatc

SEQ ID NO: 422 - DNA, 20 bp, Artificial sequence
  Synthetic Oligonucleotide
gtaggagctgtggaattcta

SEQ ID NO: 423 - DNA, 20 bp, Artificial sequence
  Synthetic Oligonucleotide
cttcagcaactgaaaagtgt

SEQ ID NO: 424 - DNA, 20 bp, Artificial sequence
  Synthetic Oligonucleotide
ctagggtggcagatattttt

SEQ ID NO: 425 - DNA, 20 bp, Artificial sequence
  Synthetic Oligonucleotide
tattgtggtaagctatgtaa

SEQ ID NO: 426 - DNA, 20 bp, Artificial sequence
  Synthetic Oligonucleotide
aaatgacctcaaattattac

SEQ ID NO: 427 - DNA, 20 bp, Artificial sequence
  Synthetic Oligonucleotide
ggtcagggccaaagaattta

SEQ ID NO: 428 - DNA, 20 bp, Artificial sequence
  Synthetic Oligonucleotide
actagttgtcctatcacagg

SEQ ID NO: 429 - DNA, 20 bp, Artificial sequence
  Synthetic Oligonucleotide
gttttcacatagtaaaatgc

SEQ ID NO: 430 - DNA, 20 bp, Artificial sequence
  Synthetic Oligonucleotide
tcatctttaagaatttgatt

SEQ ID NO: 431 - DNA, 20 bp, Artificial sequence
  Synthetic Oligonucleotide
ataacaagttaaagcatagc

SEQ ID NO: 432 - DNA, 20 bp, Artificial sequence
  Synthetic Oligonucleotide
ctggaacaaagagctctatt

SEQ ID NO: 433 - DNA, 20 bp, Artificial sequence
  Synthetic Oligonucleotide
ctttggtaaaaaaaattgca

SEQ ID NO: 434 - DNA, 20 bp, Artificial sequence
  Synthetic Oligonucleotide
attattccatttaaatatgg

SEQ ID NO: 435 - DNA, 20 bp, Artificial sequence
  Synthetic Oligonucleotide
cctttattattccatttaaa

SEQ ID NO: 436 - DNA, 20 bp, Artificial sequence
  Synthetic Oligonucleotide
aaaaacctttattattccat

SEQ ID NO: 437 - DNA, 20 bp, Artificial sequence
  Synthetic Oligonucleotide
cctctttcagtttattgtga

SEQ ID NO: 438 - DNA, 20 bp, Artificial sequence
  Synthetic Oligonucleotide
atagttgacaggaatttata

SEQ ID NO: 439 - DNA, 20 bp, Artificial sequence
  Synthetic Oligonucleotide
gtttagtggaagtattaagg

SEQ ID NO: 440 - DNA, 20 bp, Artificial sequence
  Synthetic Oligonucleotide
tatatgataacatcacacat

SEQ ID NO: 441 - DNA, 20 bp, Artificial sequence
  Synthetic Oligonucleotide
ttccatagaacactctttat

SEQ ID NO: 442 - DNA, 20 bp, Artificial sequence
  Synthetic Oligonucleotide
aggaaattatgctgtgttac

SEQ ID NO: 443 - DNA, 20 bp, Artificial sequence
  Synthetic Oligonucleotide
agaaaaatggtttatttaag

SEQ ID NO: 444 - DNA, 20 bp, Artificial sequence
  Synthetic Oligonucleotide
acactgaccatacacaagct

SEQ ID NO: 445 - DNA, 20 bp, Artificial sequence
  Synthetic Oligonucleotide
gcctagctgtgctgtcatca

SEQ ID NO: 446 - DNA, 20 bp, Artificial sequence
  Synthetic Oligonucleotide
taccagtcttatgtttcact

SEQ ID NO: 447 - DNA, 20 bp, Artificial sequence
  Synthetic Oligonucleotide
atttcccatttttgccttag

SEQ ID NO: 448 - DNA, 20 bp, Artificial sequence
  Synthetic Oligonucleotide
tgtattgctgcaagaaaaaa

SEQ ID NO: 449 - DNA, 20 bp, Artificial sequence
  Synthetic Oligonucleotide
acgcaaatatatttatgcag

SEQ ID NO: 450 - DNA, 20 bp, Artificial sequence
  Synthetic Oligonucleotide
atgttcaaaacattcattat

SEQ ID NO: 451 - DNA, 20 bp, Artificial sequence
  Synthetic Oligonucleotide
taatagtttacagtcattaa

SEQ ID NO: 452 - DNA, 20 bp, Artificial sequence
  Synthetic Oligonucleotide
tataacttcagttataagca

SEQ ID NO: 453 - DNA, 20 bp, Artificial sequence
  Synthetic Oligonucleotide
agacaagcaagatctggtag

SEQ ID NO: 454 - DNA, 20 bp, Artificial sequence
  Synthetic Oligonucleotide
acaggagctaacatttcaaa

SEQ ID NO: 455 - DNA, 20 bp, Artificial sequence
  Synthetic Oligonucleotide
aaccgtcttggagtttatat

SEQ ID NO: 456 - DNA, 20 bp, Artificial sequence
  Synthetic Oligonucleotide
tatactgatactatgtcaaa

SEQ ID NO: 457 - DNA, 20 bp, Artificial sequence
  Synthetic Oligonucleotide
cagtatttatacattaccct

SEQ ID NO: 458 - DNA, 20 bp, Artificial sequence
  Synthetic Oligonucleotide
ttttctaggtgacccttcaa

SEQ ID NO: 459 - DNA, 20 bp, Artificial sequence
  Synthetic Oligonucleotide
cctttctgcttttgtgtacc

SEQ ID NO: 460 - DNA, 20 bp, Artificial sequence
  Synthetic Oligonucleotide
aagttctttacactataaac

SEQ ID NO: 461 - DNA, 20 bp, Artificial sequence
  Synthetic Oligonucleotide
gacattatgtagatatagat

SEQ ID NO: 462 - DNA, 20 bp, Artificial sequence
  Synthetic Oligonucleotide
attattatttataaaaaact

SEQ ID NO: 463 - DNA, 20 bp, Artificial sequence
  Synthetic Oligonucleotide
tgtatctctagaaaaagaaa

SEQ ID NO: 464 - DNA, 20 bp, Artificial sequence
  Synthetic Oligonucleotide
aatcacagtcagaggttcct

SEQ ID NO: 465 - DNA, 20 bp, Artificial sequence
  Synthetic Oligonucleotide
cccttttccaaactattcat

SEQ ID NO: 466 - DNA, 20 bp, Artificial sequence
  Synthetic Oligonucleotide
gtgacaaagttgcattttat

SEQ ID NO: 467 - DNA, 20 bp, Artificial sequence
  Synthetic Oligonucleotide
tctacaagagtttgctagtg

SEQ ID NO: 468 - DNA, 20 bp, Artificial sequence
  Synthetic Oligonucleotide
aagtgctgaactctacaaga

SEQ ID NO: 469 - DNA, 20 bp, Artificial sequence
  Synthetic Oligonucleotide
ctctcacttcgctatgacag

SEQ ID NO: 470 - DNA, 20 bp, Artificial sequence
  Synthetic Oligonucleotide
aaccgtcaattttctaaaga

SEQ ID NO: 471 - DNA, 20 bp, Artificial sequence
  Synthetic Oligonucleotide
ctattcaattaaaagcttat

SEQ ID NO: 472 - DNA, 20 bp, Artificial sequence
  Synthetic Oligonucleotide
ctcaaggaaaaaacctgttt

SEQ ID NO: 473 - DNA, 20 bp, Artificial sequence
  Synthetic Oligonucleotide
aaaggcggcaatttctgata

SEQ ID NO: 474 - DNA, 20 bp, Artificial sequence
  Synthetic Oligonucleotide
tatacttgacatggtcaaaa

SEQ ID NO: 475 - DNA, 20 bp, Artificial sequence
  Synthetic Oligonucleotide
ctccaattcattctattata

SEQ ID NO: 476 - DNA, 20 bp, Artificial sequence
  Synthetic Oligonucleotide
aacatagctggtaaaattac

SEQ ID NO: 477 - DNA, 20 bp, Artificial sequence
  Synthetic Oligonucleotide
aaacattcaatgaatagaag

SEQ ID NO: 478 - DNA, 20 bp, Artificial sequence
  Synthetic Oligonucleotide
acggaagaaatttttcttca

SEQ ID NO: 479 - DNA, 20 bp, Artificial sequence
  Synthetic Oligonucleotide
ccagtcttcgattctctgcc

SEQ ID NO: 480 - DNA, 20 bp, Artificial sequence
  Synthetic Oligonucleotide
ttggctttacattattggaa

SEQ ID NO: 481 - DNA, 20 bp, Artificial sequence
  Synthetic Oligonucleotide
gtggccgttgctcacgcctg

SEQ ID NO: 482 - DNA, 20 bp, Artificial sequence
  Synthetic Oligonucleotide
tcttagacatgttgatatat

SEQ ID NO: 483 - DNA, 20 bp, Artificial sequence
  Synthetic Oligonucleotide
tcttagcaggactgatgagg

SEQ ID NO: 484 - DNA, 20 bp, Artificial sequence
  Synthetic Oligonucleotide
caaatcaattcattaccaag

SEQ ID NO: 485 - DNA, 20 bp, Artificial sequence
  Synthetic Oligonucleotide
gctctagatctttataaatg

SEQ ID NO: 486 - DNA, 20 bp, Artificial sequence
  Synthetic Oligonucleotide
tacttttcccagtataagcc

SEQ ID NO: 487 - DNA, 20 bp, Artificial sequence
  Synthetic Oligonucleotide
ccttatgccttgttaagcaa

SEQ ID NO: 488 - DNA, 20 bp, Artificial sequence
  Synthetic Oligonucleotide
gaaattagactggtaaactg

SEQ ID NO: 489 - DNA, 20 bp, Artificial sequence
  Synthetic Oligonucleotide
atcccattctgggaactgca

SEQ ID NO: 490 - DNA, 20 bp, Artificial sequence
  Synthetic Oligonucleotide
ttgtattccttgcaaaatgt

SEQ ID NO: 491 - DNA, 20 bp, Artificial sequence
  Synthetic Oligonucleotide
ttagttgcaagatagaacat

SEQ ID NO: 492 - DNA, 20 bp, Artificial sequence
  Synthetic Oligonucleotide
atggtctagtttccacagta

SEQ ID NO: 493 - DNA, 20 bp, Artificial sequence
  Synthetic Oligonucleotide
agtaagttccatttggagtc

SEQ ID NO: 494 - DNA, 20 bp, Artificial sequence
  Synthetic Oligonucleotide
gggaaattctagagaaaact

SEQ ID NO: 495 - DNA, 20 bp, Artificial sequence
  Synthetic Oligonucleotide
tgtgaagcagcccttcctaa

SEQ ID NO: 496 - DNA, 20 bp, Artificial sequence
  Synthetic Oligonucleotide
acttcaggtcacaccttcat

SEQ ID NO: 497 - DNA, 20 bp, Artificial sequence
  Synthetic Oligonucleotide
cacatcaaattaatttcttc

SEQ ID NO: 498 - DNA, 20 bp, Artificial sequence
  Synthetic Oligonucleotide
aaacagaatatgaaccatta

SEQ ID NO: 499 - DNA, 20 bp, Artificial sequence
  Synthetic Oligonucleotide
acaaaacagaatatgaacca

SEQ ID NO: 500 - DNA, 20 bp, Artificial sequence
  Synthetic Oligonucleotide
aaaacaaaacagaatatgaa

SEQ ID NO: 501 - DNA, 20 bp, Artificial sequence
  Synthetic Oligonucleotide
tacaaaacaaaacagaatat

SEQ ID NO: 502 - DNA, 20 bp, Artificial sequence
  Synthetic Oligonucleotide
tgtggataagaaaacattgt

SEQ ID NO: 503 - DNA, 20 bp, Artificial sequence
  Synthetic Oligonucleotide
tcttgacttttgcattatga

SEQ ID NO: 504 - DNA, 20 bp, Artificial sequence
  Synthetic Oligonucleotide
aaatgttaactgttcttttt

SEQ ID NO: 505 - DNA, 20 bp, Artificial sequence
  Synthetic Oligonucleotide
tcagctatgacctgtttcct

SEQ ID NO: 506 - DNA, 20 bp, Artificial sequence
  Synthetic Oligonucleotide
aaatcagctatgacctgttt

SEQ ID NO: 507 - DNA, 20 bp, Artificial sequence
  Synthetic Oligonucleotide
gtaaaaaatactatgctgtt

SEQ ID NO: 508 - DNA, 20 bp, Artificial sequence
  Synthetic Oligonucleotide
caaacattaacaattttgct

SEQ ID NO: 509 - DNA, 20 bp, Artificial sequence
  Synthetic Oligonucleotide
acctctaataaattgtgctg

SEQ ID NO: 510 - DNA, 20 bp, Artificial sequence
  Synthetic Oligonucleotide
gcatggaatagtaaaggccc

SEQ ID NO: 511 - DNA, 20 bp, Artificial sequence
  Synthetic Oligonucleotide
attgctaggtagagaactta

SEQ ID NO: 512 - DNA, 20 bp, Artificial sequence
  Synthetic Oligonucleotide
tctaataaatgaccaagtta

SEQ ID NO: 513 - DNA, 20 bp, Artificial sequence
  Synthetic Oligonucleotide
gaactttatatatagttatc

SEQ ID NO: 514 - DNA, 20 bp, Artificial sequence
  Synthetic Oligonucleotide
cttgtgggaaagcatgaatc

SEQ ID NO: 515 - DNA, 20 bp, Artificial sequence
  Synthetic Oligonucleotide
tccaacagttaacgatcatt

SEQ ID NO: 516 - DNA, 20 bp, Artificial sequence
  Synthetic Oligonucleotide
gatataatcatgatactaga

SEQ ID NO: 517 - DNA, 20 bp, Artificial sequence
  Synthetic Oligonucleotide
cagttttagtcatataacaa

SEQ ID NO: 518 - DNA, 20 bp, Artificial sequence
  Synthetic Oligonucleotide
tacagttttagtcatataac

SEQ ID NO: 519 - DNA, 20 bp, Artificial sequence
  Synthetic Oligonucleotide
atatgtatatttatatacat

SEQ ID NO: 520 - DNA, 20 bp, Artificial sequence
  Synthetic Oligonucleotide
taaatatgtatatttatata

SEQ ID NO: 521 - DNA, 20 bp, Artificial sequence
  Synthetic Oligonucleotide
gtataaatatgtatatttat

SEQ ID NO: 522 - DNA, 20 bp, Artificial sequence
  Synthetic Oligonucleotide
tgtgtataaatatgtatatt

SEQ ID NO: 523 - DNA, 20 bp, Artificial sequence
  Synthetic Oligonucleotide
atctgtgtataaatatgtat

SEQ ID NO: 524 - DNA, 20 bp, Artificial sequence
  Synthetic Oligonucleotide
tacatctgtgtataaatatg

SEQ ID NO: 525 - DNA, 20 bp, Artificial sequence
  Synthetic Oligonucleotide
atatacatctgtgtataaat

SEQ ID NO: 526 - DNA, 20 bp, Artificial sequence
  Synthetic Oligonucleotide
tttatatacatctgtgtata

SEQ ID NO: 527 - DNA, 20 bp, Artificial sequence
  Synthetic Oligonucleotide
atatttatatacatctgtgt

SEQ ID NO: 528 - DNA, 20 bp, Artificial sequence
  Synthetic Oligonucleotide
tgtatatttatatacatctg

SEQ ID NO: 529 - DNA, 20 bp, Artificial sequence
  Synthetic Oligonucleotide
ttgtatatttatatacatct

SEQ ID NO: 530 - DNA, 20 bp, Artificial sequence
  Synthetic Oligonucleotide
tatttgtatatttatataca

SEQ ID NO: 531 - DNA, 20 bp, Artificial sequence
  Synthetic Oligonucleotide
ttatatttgtatatttatat

SEQ ID NO: 532 - DNA, 20 bp, Artificial sequence
  Synthetic Oligonucleotide
tatttatatttgtatattta

SEQ ID NO: 533 - DNA, 20 bp, Artificial sequence
  Synthetic Oligonucleotide
atatatttatatttgtatat

SEQ ID NO: 534 - DNA, 20 bp, Artificial sequence
  Synthetic Oligonucleotide
tgtatatatttatatttgta

SEQ ID NO: 535 - DNA, 20 bp, Artificial sequence
  Synthetic Oligonucleotide
aaatgtatatatttatattt

SEQ ID NO: 536 - DNA, 20 bp, Artificial sequence
  Synthetic Oligonucleotide
tataaatgtatatatttata

SEQ ID NO: 537 - DNA, 20 bp, Artificial sequence
  Synthetic Oligonucleotide
atatataaatgtatatattt

SEQ ID NO: 538 - DNA, 20 bp, Artificial sequence
  Synthetic Oligonucleotide
tttatatataaatgtatata

SEQ ID NO: 539 - DNA, 20 bp, Artificial sequence
  Synthetic Oligonucleotide
atatttatatataaatgtat

SEQ ID NO: 540 - DNA, 20 bp, Artificial sequence
  Synthetic Oligonucleotide
tgtatatttatatataaatg

SEQ ID NO: 541 - DNA, 20 bp, Artificial sequence
  Synthetic Oligonucleotide
atatgtatatttatatataa

SEQ ID NO: 542 - DNA, 20 bp, Artificial sequence
  Synthetic Oligonucleotide
ccatgtttagaagaaatact

SEQ ID NO: 543 - DNA, 20 bp, Artificial sequence
  Synthetic Oligonucleotide
attacatagtttggcaaaac

SEQ ID NO: 544 - DNA, 20 bp, Artificial sequence
  Synthetic Oligonucleotide
actgcagaaatatgtacctt

SEQ ID NO: 545 - DNA, 20 bp, Artificial sequence
  Synthetic Oligonucleotide
caccccaggaagaagtccca

SEQ ID NO: 546 - DNA, 20 bp, Artificial sequence
  Synthetic Oligonucleotide
gttaaattacctttaacata

SEQ ID NO: 547 - DNA, 20 bp, Artificial sequence
  Synthetic Oligonucleotide
tccttgaaagtatcctctac

SEQ ID NO: 548 - DNA, 20 bp, Artificial sequence
  Synthetic Oligonucleotide
ccatcctatccagataaata

SEQ ID NO: 549 - DNA, 20 bp, Artificial sequence
  Synthetic Oligonucleotide
aggtgtgctttaggagaagc

SEQ ID NO: 550 - DNA, 20 bp, Artificial sequence
  Synthetic Oligonucleotide
ttattaaggcagaactccaa

SEQ ID NO: 551 - DNA, 20 bp, Artificial sequence
  Synthetic Oligonucleotide
catcccaagtgcctacagac

SEQ ID NO: 552 - DNA, 20 bp, Artificial sequence
  Synthetic Oligonucleotide
actttgaaagtggcagaaaa

SEQ ID NO: 553 - DNA, 20 bp, Artificial sequence
  Synthetic Oligonucleotide
ttacagttattttcacaaag

SEQ ID NO: 554 - DNA, 20 bp, Artificial sequence
  Synthetic Oligonucleotide
caaacattataatttctata

SEQ ID NO: 555 - DNA, 20 bp, Artificial sequence
  Synthetic Oligonucleotide
tataagcatgtggaggtatc

SEQ ID NO: 556 - DNA, 20 bp, Artificial sequence
  Synthetic Oligonucleotide
tgctatgtgctatacaatta

SEQ ID NO: 557 - DNA, 20 bp, Artificial sequence
  Synthetic Oligonucleotide
cttacaagtctgcagttacg

SEQ ID NO: 558 - DNA, 20 bp, Artificial sequence
  Synthetic Oligonucleotide
tgcccagaatctacagaatc

SEQ ID NO: 559 - DNA, 20 bp, Artificial sequence
  Synthetic Oligonucleotide
tccagggctgcaactgtaca

SEQ ID NO: 560 - DNA, 20 bp, Artificial sequence
  Synthetic Oligonucleotide
gttctgtggacactgagata

SEQ ID NO: 561 - DNA, 20 bp, Artificial sequence
  Synthetic Oligonucleotide
gctttgcttgttaactgaaa

SEQ ID NO: 562 - DNA, 20 bp, Artificial sequence
  Synthetic Oligonucleotide
tttctctcaggtatttaagc

SEQ ID NO: 563 - DNA, 20 bp, Artificial sequence
  Synthetic Oligonucleotide
gacttcttataaggtatttt

SEQ ID NO: 564 - DNA, 20 bp, Artificial sequence
  Synthetic Oligonucleotide
ggctggtacccaaacttgtc

SEQ ID NO: 565 - DNA, 20 bp, Artificial sequence
  Synthetic Oligonucleotide
caaggctggtacccaaactt

SEQ ID NO: 566 - DNA, 20 bp, Artificial sequence
  Synthetic Oligonucleotide
acaatcccagcaggtaggtg

SEQ ID NO: 567 - DNA, 20 bp, Artificial sequence
  Synthetic Oligonucleotide
atccttctgacctacgatgg

SEQ ID NO: 568 - DNA, 20 bp, Artificial sequence
  Synthetic Oligonucleotide
ctttgaactcataagataga

SEQ ID NO: 569 - DNA, 20 bp, Artificial sequence
  Synthetic Oligonucleotide
gcttattgaaagactgatct

SEQ ID NO: 570 - DNA, 20 bp, Artificial sequence
  Synthetic Oligonucleotide
gaaggaagagaacaggtatg

SEQ ID NO: 571 - DNA, 20 bp, Artificial sequence
  Synthetic Oligonucleotide
cgcctctctcacgctgcctg

SEQ ID NO: 572 - DNA, 20 bp, Artificial sequence
  Synthetic Oligonucleotide
tgcaaacaattttaataaac

SEQ ID NO: 573 - DNA, 20 bp, Artificial sequence
  Synthetic Oligonucleotide
tgactaccatggacctccaa

SEQ ID NO: 574 - DNA, 20 bp, Artificial sequence
  Synthetic Oligonucleotide
ccttcactgggtctcacttg

SEQ ID NO: 575 - DNA, 20 bp, Artificial sequence
  Synthetic Oligonucleotide
actaagctgaaactatgaat

SEQ ID NO: 576 - DNA, 20 bp, Artificial sequence
  Synthetic Oligonucleotide
ctgattgattgttaactaac

SEQ ID NO: 577 - DNA, 20 bp, Artificial sequence
  Synthetic Oligonucleotide
ttataagtaagtagatttga

SEQ ID NO: 578 - DNA, 20 bp, Artificial sequence
  Synthetic Oligonucleotide
agattgttgcacaaatattt

SEQ ID NO: 579 - DNA, 20 bp, Artificial sequence
  Synthetic Oligonucleotide
tactattcaaatggatataa

SEQ ID NO: 580 - DNA, 20 bp, Artificial sequence
  Synthetic Oligonucleotide
gaactatgctaaaaacacta

SEQ ID NO: 581 - DNA, 20 bp, Artificial sequence
  Synthetic Oligonucleotide
ttttgtgtgagtaggctgtg

SEQ ID NO: 582 - DNA, 20 bp, Artificial sequence
  Synthetic Oligonucleotide
tatattcaacataccctgtt

SEQ ID NO: 583 - DNA, 20 bp, Artificial sequence
  Synthetic Oligonucleotide
tacaacataaattcttgcca

SEQ ID NO: 584 - DNA, 20 bp, Artificial sequence
  Synthetic Oligonucleotide
aatcttactgtcaatatagt

SEQ ID NO: 585 - DNA, 20 bp, Artificial sequence
  Synthetic Oligonucleotide
ttaaaaggaagtaaccatgt

SEQ ID NO: 586 - DNA, 20 bp, Artificial sequence
  Synthetic Oligonucleotide
tggtatccctcctaagtgct

SEQ ID NO: 587 - DNA, 20 bp, Artificial sequence
  Synthetic Oligonucleotide
ctctcttggctcccgactgc

SEQ ID NO: 588 - DNA, 20 bp, Artificial sequence
  Synthetic Oligonucleotide
taccttatttggaactctgc

SEQ ID NO: 589 - DNA, 20 bp, Artificial sequence
  Synthetic Oligonucleotide
ttacttatatgtaatttgtt

SEQ ID NO: 590 - DNA, 20 bp, Artificial sequence
  Synthetic Oligonucleotide
catcctgtaaacctttttta

SEQ ID NO: 591 - DNA, 20 bp, Artificial sequence
  Synthetic Oligonucleotide
aaagattaaattaagctgca

SEQ ID NO: 592 - DNA, 20 bp, Artificial sequence
  Synthetic Oligonucleotide
acattaggaatctcacctca

SEQ ID NO: 593 - DNA, 20 bp, Artificial sequence
  Synthetic Oligonucleotide
ctgaatataaatattatcta

SEQ ID NO: 594 - DNA, 20 bp, Artificial sequence
  Synthetic Oligonucleotide
atgtatagctagaatgagga

SEQ ID NO: 595 - DNA, 20 bp, Artificial sequence
  Synthetic Oligonucleotide
agatgcaactcaagaaaact

SEQ ID NO: 596 - DNA, 20 bp, Artificial sequence
  Synthetic Oligonucleotide
tatttataaagcacctatct

SEQ ID NO: 597 - DNA, 20 bp, Artificial sequence
  Synthetic Oligonucleotide
aaattatatcaaattgatat

SEQ ID NO: 598 - DNA, 20 bp, Artificial sequence
  Synthetic Oligonucleotide
ttttatagaggctgaggaga

SEQ ID NO: 599 - DNA, 20 bp, Artificial sequence
  Synthetic Oligonucleotide
gccaaactttaaagatgcag

SEQ ID NO: 600 - DNA, 20 bp, Artificial sequence
  Synthetic Oligonucleotide
cgaataaactcagctagctg

SEQ ID NO: 601 - DNA, 20 bp, Artificial sequence
  Synthetic Oligonucleotide
gacagttattatatatcatg

SEQ ID NO: 602 - DNA, 20 bp, Artificial sequence
  Synthetic Oligonucleotide
aaatttattcttaatctccc

SEQ ID NO: 603 - DNA, 20 bp, Artificial sequence
  Synthetic Oligonucleotide
aaaacaagtgaatgctacag

SEQ ID NO: 604 - DNA, 20 bp, Artificial sequence
  Synthetic Oligonucleotide
ctcttatgatgctgagtatc

SEQ ID NO: 605 - DNA, 20 bp, Artificial sequence
  Synthetic Oligonucleotide
atgttttaatgaaagattgg

SEQ ID NO: 606 - DNA, 20 bp, Artificial sequence
  Synthetic Oligonucleotide
ttaactatagatatattggg

SEQ ID NO: 607 - DNA, 20 bp, Artificial sequence
  Synthetic Oligonucleotide
ggcaaaatgaataaacagta

SEQ ID NO: 608 - DNA, 20 bp, Artificial sequence
  Synthetic Oligonucleotide
ttgaatatttacctgacaaa

SEQ ID NO: 609 - DNA, 20 bp, Artificial sequence
  Synthetic Oligonucleotide
agtgttacacaactttggcc

SEQ ID NO: 610 - DNA, 20 bp, Artificial sequence
  Synthetic Oligonucleotide
gagggctttaaagaaagata

SEQ ID NO: 611 - DNA, 20 bp, Artificial sequence
  Synthetic Oligonucleotide
tgtagtacagttgtatcagg

SEQ ID NO: 612 - DNA, 20 bp, Artificial sequence
  Synthetic Oligonucleotide
taaacctaatacataatcct

SEQ ID NO: 613 - DNA, 20 bp, Artificial sequence
  Synthetic Oligonucleotide
tctttaaacctaatacataa

SEQ ID NO: 614 - DNA, 20 bp, Artificial sequence
  Synthetic Oligonucleotide
attagaacctactggacctt

SEQ ID NO: 615 - DNA, 20 bp, Artificial sequence
  Synthetic Oligonucleotide
ttttctctaagatatgccat

SEQ ID NO: 616 - DNA, 20 bp, Artificial sequence
  Synthetic Oligonucleotide
gctcatagcaaaattaaaag

SEQ ID NO: 617 - DNA, 20 bp, Artificial sequence
  Synthetic Oligonucleotide
tttcatttaatgtagcactg

SEQ ID NO: 618 - DNA, 20 bp, Artificial sequence
  Synthetic Oligonucleotide
agcaactgagacttggattt

SEQ ID NO: 619 - DNA, 20 bp, Artificial sequence
  Synthetic Oligonucleotide
acatttagtgtgaacaaatg

SEQ ID NO: 620 - DNA, 20 bp, Artificial sequence
  Synthetic Oligonucleotide
tgctagtgagtgcatcataa

SEQ ID NO: 621 - DNA, 20 bp, Artificial sequence
  Synthetic Oligonucleotide
tggatgggtacttttctcta

SEQ ID NO: 622 - DNA, 20 bp, Artificial sequence
  Synthetic Oligonucleotide
aggtagagagagagtaacac

SEQ ID NO: 623 - DNA, 20 bp, Artificial sequence
  Synthetic Oligonucleotide
atttagagctaggtagagag

SEQ ID NO: 624 - DNA, 20 bp, Artificial sequence
  Synthetic Oligonucleotide
tgagaaataaagtgctatag

SEQ ID NO: 625 - DNA, 20 bp, Artificial sequence
  Synthetic Oligonucleotide
tgaatggtagtatatgtgag

SEQ ID NO: 626 - DNA, 20 bp, Artificial sequence
  Synthetic Oligonucleotide
acattgtgaggtcaaaaaag

SEQ ID NO: 627 - DNA, 20 bp, Artificial sequence
  Synthetic Oligonucleotide
tccctctccaatgggcccac

SEQ ID NO: 628 - DNA, 20 bp, Artificial sequence
  Synthetic Oligonucleotide
ttccagagtaatatgttatg

SEQ ID NO: 629 - DNA, 20 bp, Artificial sequence
  Synthetic Oligonucleotide
gataaaccccaagaaggcaa

SEQ ID NO: 630 - DNA, 20 bp, Artificial sequence
  Synthetic Oligonucleotide
tacattatgtattagctcta

SEQ ID NO: 631 - DNA, 20 bp, Artificial sequence
  Synthetic Oligonucleotide
gtgttcaagtcatagaaatg

SEQ ID NO: 632 - DNA, 20 bp, Artificial sequence
  Synthetic Oligonucleotide
aaccaattagtataacattt

SEQ ID NO: 633 - DNA, 20 bp, Artificial sequence
  Synthetic Oligonucleotide
ctcattttttgccctctcaa

SEQ ID NO: 634 - DNA, 20 bp, Artificial sequence
  Synthetic Oligonucleotide
taattttcaaagcgcatgaa

SEQ ID NO: 635 - DNA, 20 bp, Artificial sequence
  Synthetic Oligonucleotide
atgttaattttcaaagcgca

SEQ ID NO: 636 - DNA, 20 bp, Artificial sequence
  Synthetic Oligonucleotide
gaagaaacttttttggataa

SEQ ID NO: 637 - DNA, 20 bp, Artificial sequence
  Synthetic Oligonucleotide
aataaatttggcaacttata

SEQ ID NO: 638 - DNA, 20 bp, Artificial sequence
  Synthetic Oligonucleotide
gagaaagtaacacaaacaat

SEQ ID NO: 639 - DNA, 20 bp, Artificial sequence
  Synthetic Oligonucleotide
caaatcctcaattacaactt

SEQ ID NO: 640 - DNA, 20 bp, Artificial sequence
  Synthetic Oligonucleotide
accaacaaatcctcaattac

SEQ ID NO: 641 - DNA, 20 bp, Artificial sequence
  Synthetic Oligonucleotide
ggagatagagatcaacattt

SEQ ID NO: 642 - DNA, 20 bp, Artificial sequence
  Synthetic Oligonucleotide
aattaagggccatatacata

SEQ ID NO: 643 - DNA, 20 bp, Artificial sequence
  Synthetic Oligonucleotide
acccaattatgaggataaaa

SEQ ID NO: 644 - DNA, 20 bp, Artificial sequence
  Synthetic Oligonucleotide
tcatttattggagaagagga

SEQ ID NO: 645 - DNA, 20 bp, Artificial sequence
  Synthetic Oligonucleotide
aaaccaaactatggagttta

SEQ ID NO: 646 - DNA, 20 bp, Artificial sequence
  Synthetic Oligonucleotide
aagtcctgtcctcaaagagt

SEQ ID NO: 647 - DNA, 20 bp, Artificial sequence
  Synthetic Oligonucleotide
aacaagtcctgtcctcaaag

SEQ ID NO: 648 - DNA, 20 bp, Artificial sequence
  Synthetic Oligonucleotide
aacaaacaaagtgccatcta

SEQ ID NO: 649 - DNA, 20 bp, Artificial sequence
  Synthetic Oligonucleotide
attatagaggcttattaacc

SEQ ID NO: 650 - DNA, 20 bp, Artificial sequence
  Synthetic Oligonucleotide
tagagttgaaagcttccttc

SEQ ID NO: 651 - DNA, 20 bp, Artificial sequence
  Synthetic Oligonucleotide
ccatctgaggaacttaagtc

SEQ ID NO: 652 - DNA, 20 bp, Artificial sequence
  Synthetic Oligonucleotide
gtcaaactcttcagagtctg

SEQ ID NO: 653 - DNA, 20 bp, Artificial sequence
  Synthetic Oligonucleotide
tatatagtatatatataata

SEQ ID NO: 654 - DNA, 20 bp, Artificial sequence
  Synthetic Oligonucleotide
ttatatatagtatatatata

SEQ ID NO: 655 - DNA, 20 bp, Artificial sequence
  Synthetic Oligonucleotide
gtattatatatagtatatat

SEQ ID NO: 656 - DNA, 20 bp, Artificial sequence
  Synthetic Oligonucleotide
taagtattatatatagtata

SEQ ID NO: 657 - DNA, 20 bp, Artificial sequence
  Synthetic Oligonucleotide
taataagtattatatatagt

SEQ ID NO: 658 - DNA, 20 bp, Artificial sequence
  Synthetic Oligonucleotide
atataataagtattatatat

SEQ ID NO: 659 - DNA, 20 bp, Artificial sequence
  Synthetic Oligonucleotide
tatatataataagtattata

SEQ ID NO: 660 - DNA, 20 bp, Artificial sequence
  Synthetic Oligonucleotide
tttcatagttttatagcatt

SEQ ID NO: 661 - DNA, 20 bp, Artificial sequence
  Synthetic Oligonucleotide
gtcttatagttgggaacgaa

SEQ ID NO: 662 - DNA, 20 bp, Artificial sequence
  Synthetic Oligonucleotide
actatcattttaacctctga

SEQ ID NO: 663 - DNA, 20 bp, Artificial sequence
  Synthetic Oligonucleotide
acagtaggccaagtaactat

SEQ ID NO: 664 - DNA, 20 bp, Artificial sequence
  Synthetic Oligonucleotide
aagtgatgataataatttgc

SEQ ID NO: 665 - DNA, 20 bp, Artificial sequence
  Synthetic Oligonucleotide
tggccaatattcaggagggt

SEQ ID NO: 666 - DNA, 20 bp, Artificial sequence
  Synthetic Oligonucleotide
gctttgcttactagtgagtg

SEQ ID NO: 667 - DNA, 20 bp, Artificial sequence
  Synthetic Oligonucleotide
gtttgaaggaatagctgaca

SEQ ID NO: 668 - DNA, 20 bp, Artificial sequence
  Synthetic Oligonucleotide
agtgtttgaaggaatagctg

SEQ ID NO: 669 - DNA, 20 bp, Artificial sequence
  Synthetic Oligonucleotide
catagtgtttgaaggaatag

SEQ ID NO: 670 - DNA, 20 bp, Artificial sequence
  Synthetic Oligonucleotide
agccatagtgtttgaaggaa

SEQ ID NO: 671 - DNA, 20 bp, Artificial sequence
  Synthetic Oligonucleotide
aaaagccatagtgtttgaag

SEQ ID NO: 672 - DNA, 20 bp, Artificial sequence
  Synthetic Oligonucleotide
ctaaaaagccatagtgtttg

SEQ ID NO: 673 - DNA, 20 bp, Artificial sequence
  Synthetic Oligonucleotide
attctaaaaagccatagtgt

SEQ ID NO: 674 - DNA, 20 bp, Artificial sequence
  Synthetic Oligonucleotide
gcagcatcatgcaagcagca

SEQ ID NO: 675 - DNA, 20 bp, Artificial sequence
  Synthetic Oligonucleotide
attgcagcatcatgcaagca

SEQ ID NO: 676 - DNA, 20 bp, Artificial sequence
  Synthetic Oligonucleotide
tggcggaatgcagaaattta

SEQ ID NO: 677 - DNA, 20 bp, Artificial sequence
  Synthetic Oligonucleotide
gtgggaaggaagaaatgtgc

SEQ ID NO: 678 - DNA, 20 bp, Artificial sequence
  Synthetic Oligonucleotide
agcatattaatgccaaatat

SEQ ID NO: 679 - DNA, 20 bp, Artificial sequence
  Synthetic Oligonucleotide
aaaggcaaatgacacacagc

SEQ ID NO: 680 - DNA, 20 bp, Artificial sequence
  Synthetic Oligonucleotide
attagtctggctaagaagaa

SEQ ID NO: 681 - DNA, 20 bp, Artificial sequence
  Synthetic Oligonucleotide
acagagctgaggtctgcaac

SEQ ID NO: 682 - DNA, 20 bp, Artificial sequence
  Synthetic Oligonucleotide
aagctcaggagttcagaaaa

SEQ ID NO: 683 - DNA, 20 bp, Artificial sequence
  Synthetic Oligonucleotide
ggtttctggatattagaaca

SEQ ID NO: 684 - DNA, 20 bp, Artificial sequence
  Synthetic Oligonucleotide
ttgtcagcaaccgatcaaag

SEQ ID NO: 685 - DNA, 20 bp, Artificial sequence
  Synthetic Oligonucleotide
caatttggagtctacaatga

SEQ ID NO: 686 - DNA, 20 bp, Artificial sequence
  Synthetic Oligonucleotide
aaatgtaaccttacgacatt

SEQ ID NO: 687 - DNA, 20 bp, Artificial sequence
  Synthetic Oligonucleotide
taatgctaacagcaacaagg

SEQ ID NO: 688 - DNA, 20 bp, Artificial sequence
  Synthetic Oligonucleotide
tcacctttacccttgtgatt

SEQ ID NO: 689 - DNA, 20 bp, Artificial sequence
  Synthetic Oligonucleotide
caggccaaataggactctat

SEQ ID NO: 690 - DNA, 20 bp, Artificial sequence
  Synthetic Oligonucleotide
agtcatattagtttctaatt

SEQ ID NO: 691 - DNA, 20 bp, Artificial sequence
  Synthetic Oligonucleotide
ctgctctgctaatgggctgg

SEQ ID NO: 692 - DNA, 20 bp, Artificial sequence
  Synthetic Oligonucleotide
ttcatgtatctcttaaccca

SEQ ID NO: 693 - DNA, 20 bp, Artificial sequence
  Synthetic Oligonucleotide
acttccatatttacctgcaa

SEQ ID NO: 694 - DNA, 20 bp, Artificial sequence
  Synthetic Oligonucleotide
tgcactaaactcatttgaca

SEQ ID NO: 695 - DNA, 20 bp, Artificial sequence
  Synthetic Oligonucleotide
gcatcatctcagggagccat

SEQ ID NO: 696 - DNA, 20 bp, Artificial sequence
  Synthetic Oligonucleotide
cagcatatctcagcatacct

SEQ ID NO: 697 - DNA, 20 bp, Artificial sequence
  Synthetic Oligonucleotide
caaacagtgaaacatggaat

SEQ ID NO: 698 - DNA, 20 bp, Artificial sequence
  Synthetic Oligonucleotide
ttcaattgactaattcagta

SEQ ID NO: 699 - DNA, 20 bp, Artificial sequence
  Synthetic Oligonucleotide
gctgattgcaatgtttcaat

SEQ ID NO: 700 - DNA, 20 bp, Artificial sequence
  Synthetic Oligonucleotide
aaatcacattatccatgaca

SEQ ID NO: 701 - DNA, 20 bp, Artificial sequence
  Synthetic Oligonucleotide
aatagctgtcagacaagttg

SEQ ID NO: 702 - DNA, 20 bp, Artificial sequence
  Synthetic Oligonucleotide
ttagagcttctgcaccatga

SEQ ID NO: 703 - DNA, 20 bp, Artificial sequence
  Synthetic Oligonucleotide
ttccacctgattaattgaat

SEQ ID NO: 704 - DNA, 20 bp, Artificial sequence
  Synthetic Oligonucleotide
attttttaaagagtttgtgc

SEQ ID NO: 705 - DNA, 20 bp, Artificial sequence
  Synthetic Oligonucleotide
tataaactcataggccctgg

SEQ ID NO: 706 - DNA, 20 bp, Artificial sequence
  Synthetic Oligonucleotide
gtttaaggaatacttaaaca

SEQ ID NO: 707 - DNA, 20 bp, Artificial sequence
  Synthetic Oligonucleotide
tgccctgagaatgaaataac

SEQ ID NO: 708 - DNA, 20 bp, Artificial sequence
  Synthetic Oligonucleotide
tttgatggattctacttgca

SEQ ID NO: 709 - DNA, 20 bp, Artificial sequence
  Synthetic Oligonucleotide
ctcaaagtaactactgcatt

SEQ ID NO: 710 - DNA, 20 bp, Artificial sequence
  Synthetic Oligonucleotide
tctaaaaatctaataagtct

SEQ ID NO: 711 - DNA, 20 bp, Artificial sequence
  Synthetic Oligonucleotide
tactccaaggttttatgagc

SEQ ID NO: 712 - DNA, 20 bp, Artificial sequence
  Synthetic Oligonucleotide
aagagataattacagtccct

SEQ ID NO: 713 - DNA, 20 bp, Artificial sequence
  Synthetic Oligonucleotide
ctaaacgcaaaactttctga

SEQ ID NO: 714 - DNA, 20 bp, Artificial sequence
  Synthetic Oligonucleotide
tagaatacaagattttattg

SEQ ID NO: 715 - DNA, 20 bp, Artificial sequence
  Synthetic Oligonucleotide
tgagcacctaaacatgctac

SEQ ID NO: 716 - DNA, 20 bp, Artificial sequence
  Synthetic Oligonucleotide
acagcatcgcaggtcttgta

SEQ ID NO: 717 - DNA, 20 bp, Artificial sequence
  Synthetic Oligonucleotide
aatgcatttcatagttgtcc

SEQ ID NO: 718 - DNA, 20 bp, Artificial sequence
  Synthetic Oligonucleotide
ttctctatttgagaatcgcc

SEQ ID NO: 719 - DNA, 20 bp, Artificial sequence
  Synthetic Oligonucleotide
aaatttcaagttggagtagg

SEQ ID NO: 720 - DNA, 20 bp, Artificial sequence
  Synthetic Oligonucleotide
gtcatatagtggcccctaaa

SEQ ID NO: 721 - DNA, 20 bp, Artificial sequence
  Synthetic Oligonucleotide
cactggtatgcccttccaac

SEQ ID NO: 722 - DNA, 20 bp, Artificial sequence
  Synthetic Oligonucleotide
gaatttcttacttgtcttaa

SEQ ID NO: 723 - DNA, 20 bp, Artificial sequence
  Synthetic Oligonucleotide
gctacataaaataaatcacc

SEQ ID NO: 724 - DNA, 20 bp, Artificial sequence
  Synthetic Oligonucleotide
agagtctgaagtatctagaa

SEQ ID NO: 725 - DNA, 20 bp, Artificial sequence
  Synthetic Oligonucleotide
tgaagcctggaaccagttta

SEQ ID NO: 726 - DNA, 20 bp, Artificial sequence
  Synthetic Oligonucleotide
cctaaagccaattagcacaa

SEQ ID NO: 727 - DNA, 20 bp, Artificial sequence
  Synthetic Oligonucleotide
agtgtagccactaagaattt

SEQ ID NO: 728 - DNA, 20 bp, Artificial sequence
  Synthetic Oligonucleotide
cttatacactaattggctct

SEQ ID NO: 729 - DNA, 20 bp, Artificial sequence
  Synthetic Oligonucleotide
tttcttccaccattccctta

SEQ ID NO: 730 - DNA, 20 bp, Artificial sequence
  Synthetic Oligonucleotide
ctcactaattgcaaagaaaa

SEQ ID NO: 731 - DNA, 20 bp, Artificial sequence
  Synthetic Oligonucleotide
caaagcttcagactgtgatc

SEQ ID NO: 732 - DNA, 20 bp, Artificial sequence
  Synthetic Oligonucleotide
tcagagaggcccgccatggg

SEQ ID NO: 733 - DNA, 20 bp, Artificial sequence
  Synthetic Oligonucleotide
ttcacatggctgaagtcttg

SEQ ID NO: 734 - DNA, 20 bp, Artificial sequence
  Synthetic Oligonucleotide
atctactgaattctggttag

SEQ ID NO: 735 - DNA, 20 bp, Artificial sequence
  Synthetic Oligonucleotide
gcacacagtgtagtcatact

SEQ ID NO: 736 - DNA, 20 bp, Artificial sequence
  Synthetic Oligonucleotide
aacccaagattccccctggt

SEQ ID NO: 737 - DNA, 20 bp, Artificial sequence
  Synthetic Oligonucleotide
tggagaagtaagctaacagt

SEQ ID NO: 738 - DNA, 20 bp, Artificial sequence
  Synthetic Oligonucleotide
taactgaaaattcaagcctg

SEQ ID NO: 739 - DNA, 20 bp, Artificial sequence
  Synthetic Oligonucleotide
cttaaggaaaatgagctctc

SEQ ID NO: 740 - DNA, 20 bp, Artificial sequence
  Synthetic Oligonucleotide
tataatatctagctttccct

SEQ ID NO: 741 - DNA, 20 bp, Artificial sequence
  Synthetic Oligonucleotide
cagagggagaaaaacactga

SEQ ID NO: 742 - DNA, 20 bp, Artificial sequence
  Synthetic Oligonucleotide
cccttgagggtgtcacaatc

SEQ ID NO: 743 - DNA, 20 bp, Artificial sequence
  Synthetic Oligonucleotide
atctttgtatctctgctccc

SEQ ID NO: 744 - DNA, 20 bp, Artificial sequence
  Synthetic Oligonucleotide
ttgaaataataagtaaagat

SEQ ID NO: 745 - DNA, 20 bp, Artificial sequence
  Synthetic Oligonucleotide
ataagacatgcctctttaag

SEQ ID NO: 746 - DNA, 20 bp, Artificial sequence
  Synthetic Oligonucleotide
agtacatattatttaactgc

SEQ ID NO: 747 - DNA, 20 bp, Artificial sequence
  Synthetic Oligonucleotide
actgttggttttggctcaca

SEQ ID NO: 748 - DNA, 20 bp, Artificial sequence
  Synthetic Oligonucleotide
tctggagactgacccacgca

SEQ ID NO: 749 - DNA, 20 bp, Artificial sequence
  Synthetic Oligonucleotide
gctgagtggaggtatctgcc

SEQ ID NO: 750 - DNA, 20 bp, Artificial sequence
  Synthetic Oligonucleotide
atatggtttaggagagacta

SEQ ID NO: 751 - DNA, 20 bp, Artificial sequence
  Synthetic Oligonucleotide
atacttaactcatggataga

SEQ ID NO: 752 - DNA, 20 bp, Artificial sequence
  Synthetic Oligonucleotide
aaaagtgcaattgccatagg

SEQ ID NO: 753 - DNA, 20 bp, Artificial sequence
  Synthetic Oligonucleotide
ccggtaacattttatttacc

SEQ ID NO: 754 - DNA, 20 bp, Artificial sequence
  Synthetic Oligonucleotide
tcaatgtattgttgccaaat

SEQ ID NO: 755 - DNA, 20 bp, Artificial sequence
  Synthetic Oligonucleotide
atgagctacccacacagtca

SEQ ID NO: 756 - DNA, 20 bp, Artificial sequence
  Synthetic Oligonucleotide
ttggaaggatggagacatcg

SEQ ID NO: 757 - DNA, 20 bp, Artificial sequence
  Synthetic Oligonucleotide
tgatatggcatgatgtctac

SEQ ID NO: 758 - DNA, 20 bp, Artificial sequence
  Synthetic Oligonucleotide
agatgatatgctatgacata

SEQ ID NO: 759 - DNA, 20 bp, Artificial sequence
  Synthetic Oligonucleotide
tgtcctgtctcataacatct

SEQ ID NO: 760 - DNA, 20 bp, Artificial sequence
  Synthetic Oligonucleotide
agaatatttatgcactaaac

SEQ ID NO: 761 - DNA, 20 bp, Artificial sequence
  Synthetic Oligonucleotide
gttctaacagcaatttcctt

SEQ ID NO: 762 - DNA, 20 bp, Artificial sequence
  Synthetic Oligonucleotide
atccttatgtcctcacagat

SEQ ID NO: 763 - DNA, 20 bp, Artificial sequence
  Synthetic Oligonucleotide
tatttcctctcaatgtttat

SEQ ID NO: 764 - DNA, 20 bp, Artificial sequence
  Synthetic Oligonucleotide
ttaaaaaaaggaatgggata

SEQ ID NO: 765 - DNA, 20 bp, Artificial sequence
  Synthetic Oligonucleotide
caacctgaaaaaattagtct

SEQ ID NO: 766 - DNA, 20 bp, Artificial sequence
  Synthetic Oligonucleotide
ataaatgagttgatcagtgg

SEQ ID NO: 767 - DNA, 20 bp, Artificial sequence
  Synthetic Oligonucleotide
tattcctggatgagaaaaat

SEQ ID NO: 768 - DNA, 20 bp, Artificial sequence
  Synthetic Oligonucleotide
cctaagactggttaaaatat

SEQ ID NO: 769 - DNA, 20 bp, Artificial sequence
  Synthetic Oligonucleotide
ataaggaaagttgttctggg

SEQ ID NO: 770 - DNA, 20 bp, Artificial sequence
  Synthetic Oligonucleotide
atgcaataacaattatgcac

SEQ ID NO: 771 - DNA, 20 bp, Artificial sequence
  Synthetic Oligonucleotide
ggagttgatatttcaggtac

SEQ ID NO: 772 - DNA, 20 bp, Artificial sequence
  Synthetic Oligonucleotide
ttttcagaggatctactgtg

SEQ ID NO: 773 - DNA, 20 bp, Artificial sequence
  Synthetic Oligonucleotide
taaatgtgaggaaatatttg

SEQ ID NO: 774 - DNA, 20 bp, Artificial sequence
  Synthetic Oligonucleotide
catatgtatagtccgtgaat

SEQ ID NO: 775 - DNA, 20 bp, Artificial sequence
  Synthetic Oligonucleotide
tcactgaggaatgtgataaa

SEQ ID NO: 776 - DNA, 20 bp, Artificial sequence
  Synthetic Oligonucleotide
tttattgacagcttaccagg

SEQ ID NO: 777 - DNA, 20 bp, Artificial sequence
  Synthetic Oligonucleotide
agcaaaaaacaaaggagtca

SEQ ID NO: 778 - DNA, 20 bp, Artificial sequence
  Synthetic Oligonucleotide
gagaacagtgagaagtacaa

SEQ ID NO: 779 - DNA, 20 bp, Artificial sequence
  Synthetic Oligonucleotide
tagagatctgagtcaatttc

SEQ ID NO: 780 - DNA, 20 bp, Artificial sequence
  Synthetic Oligonucleotide
gctactgtgaaggaaaacat

SEQ ID NO: 781 - DNA, 20 bp, Artificial sequence
  Synthetic Oligonucleotide
atccaaatgttaaccacata

SEQ ID NO: 782 - DNA, 20 bp, Artificial sequence
  Synthetic Oligonucleotide
acaggagatacttgttcaga

SEQ ID NO: 783 - DNA, 20 bp, Artificial sequence
  Synthetic Oligonucleotide
tagaaaatagttccaattag

SEQ ID NO: 784 - DNA, 20 bp, Artificial sequence
  Synthetic Oligonucleotide
ccttaaaatatttccctttc

SEQ ID NO: 785 - DNA, 20 bp, Artificial sequence
  Synthetic Oligonucleotide
aaagataattcttttgggaa

SEQ ID NO: 786 - DNA, 20 bp, Artificial sequence
  Synthetic Oligonucleotide
gtacaaatatgagtatttag

SEQ ID NO: 787 - DNA, 20 bp, Artificial sequence
  Synthetic Oligonucleotide
gagctcagctcaccgcccgc

SEQ ID NO: 788 - DNA, 20 bp, Artificial sequence
  Synthetic Oligonucleotide
gccggccacagctccccggg

SEQ ID NO: 789 - DNA, 20 bp, Artificial sequence
  Synthetic Oligonucleotide
ccgccctcccagcatgaacg

SEQ ID NO: 790 - DNA, 20 bp, Artificial sequence
  Synthetic Oligonucleotide
tccaacccgccgccctccca

SEQ ID NO: 791 - DNA, 20 bp, Artificial sequence
  Synthetic Oligonucleotide
tagccatggtggcacctgct

SEQ ID NO: 792 - DNA, 20 bp, Artificial sequence
  Synthetic Oligonucleotide
agctgccactagccatggtg

SEQ ID NO: 793 - DNA, 20 bp, Artificial sequence
  Synthetic Oligonucleotide
acccctgacagctgccacta

SEQ ID NO: 794 - DNA, 20 bp, Artificial sequence
  Synthetic Oligonucleotide
cctcttcgcacccctgacag

SEQ ID NO: 795 - DNA, 20 bp, Artificial sequence
  Synthetic Oligonucleotide
tatctgttttccttcctgga

SEQ ID NO: 796 - DNA, 20 bp, Artificial sequence
  Synthetic Oligonucleotide
ctatctgttttccttcctgg

SEQ ID NO: 797 - DNA, 20 bp, Artificial sequence
  Synthetic Oligonucleotide
tctatctgttttccttcctg

SEQ ID NO: 798 - DNA, 20 bp, Artificial sequence
  Synthetic Oligonucleotide
ttctatctgttttccttcct

SEQ ID NO: 799 - DNA, 20 bp, Artificial sequence
  Synthetic Oligonucleotide
tttctatctgttttccttcc

SEQ ID NO: 800 - DNA, 20 bp, Artificial sequence
  Synthetic Oligonucleotide
cgtttctatctgttttcctt

SEQ ID NO: 801 - DNA, 20 bp, Artificial sequence
  Synthetic Oligonucleotide
ctccaggatttggaccagcg

SEQ ID NO: 802 - DNA, 20 bp, Artificial sequence
  Synthetic Oligonucleotide
cagcagatcctccaggattt

SEQ ID NO: 803 - DNA, 20 bp, Artificial sequence
  Synthetic Oligonucleotide
cgtgaacaccagcagatcct

SEQ ID NO: 804 - DNA, 20 bp, Artificial sequence
  Synthetic Oligonucleotide
tatttttgccttgaaataac

SEQ ID NO: 805 - DNA, 20 bp, Artificial sequence
  Synthetic Oligonucleotide
gcacatggatatttttgcct

SEQ ID NO: 806 - DNA, 20 bp, Artificial sequence
  Synthetic Oligonucleotide
tcaacagaggcacatggata

SEQ ID NO: 807 - DNA, 20 bp, Artificial sequence
  Synthetic Oligonucleotide
gactctcatataggagtcca

SEQ ID NO: 808 - DNA, 20 bp, Artificial sequence
  Synthetic Oligonucleotide
cacactcgcgactctcatat

SEQ ID NO: 809 - DNA, 20 bp, Artificial sequence
  Synthetic Oligonucleotide
cacctgctgcacactcgcga

SEQ ID NO: 810 - DNA, 20 bp, Artificial sequence
  Synthetic Oligonucleotide
tgaccaacccacctgctgca

SEQ ID NO: 811 - DNA, 20 bp, Artificial sequence
  Synthetic Oligonucleotide
tctattaatttgcacagaag

SEQ ID NO: 812 - DNA, 20 bp, Artificial sequence
  Synthetic Oligonucleotide
ggacagacttctattaattt

SEQ ID NO: 813 - DNA, 20 bp, Artificial sequence
  Synthetic Oligonucleotide
attgtacctggacagacttc

SEQ ID NO: 814 - DNA, 20 bp, Artificial sequence
  Synthetic Oligonucleotide
atcatttccaacatcctggg

SEQ ID NO: 815 - DNA, 20 bp, Artificial sequence
  Synthetic Oligonucleotide
gacttcccaatcatttccaa

SEQ ID NO: 816 - DNA, 20 bp, Artificial sequence
  Synthetic Oligonucleotide
taagaatcaattggtgaaca

SEQ ID NO: 817 - DNA, 20 bp, Artificial sequence
  Synthetic Oligonucleotide
ttagcattttaagaatcaat

SEQ ID NO: 818 - DNA, 20 bp, Artificial sequence
  Synthetic Oligonucleotide
attatgaactgttagcattt

SEQ ID NO: 819 - DNA, 20 bp, Artificial sequence
  Synthetic Oligonucleotide
aatcactgacaagtttacac

SEQ ID NO: 820 - DNA, 20 bp, Artificial sequence
  Synthetic Oligonucleotide
cttcagtccaatcactgaca

SEQ ID NO: 821 - DNA, 20 bp, Artificial sequence
  Synthetic Oligonucleotide
atctaaggtcttcagtccaa

SEQ ID NO: 822 - DNA, 20 bp, Artificial sequence
  Synthetic Oligonucleotide
agttaggaggagatctaagg

SEQ ID NO: 823 - DNA, 20 bp, Artificial sequence
  Synthetic Oligonucleotide
aagttaggaggagatctaag

SEQ ID NO: 824 - DNA, 20 bp, Artificial sequence
  Synthetic Oligonucleotide
gaagttaggaggagatctaa

SEQ ID NO: 825 - DNA, 20 bp, Artificial sequence
  Synthetic Oligonucleotide
tgaagttaggaggagatcta

SEQ ID NO: 826 - DNA, 20 bp, Artificial sequence
  Synthetic Oligonucleotide
ctgaagttaggaggagatct

SEQ ID NO: 827 - DNA, 20 bp, Artificial sequence
  Synthetic Oligonucleotide
acctgaagttaggaggagat

SEQ ID NO: 828 - DNA, 20 bp, Artificial sequence
  Synthetic Oligonucleotide
tacctgaagttaggaggaga

SEQ ID NO: 829 - DNA, 20 bp, Artificial sequence
  Synthetic Oligonucleotide
ttacctgaagttaggaggag

SEQ ID NO: 830 - DNA, 20 bp, Artificial sequence
  Synthetic Oligonucleotide
tttacctgaagttaggagga

SEQ ID NO: 831 - DNA, 20 bp, Artificial sequence
  Synthetic Oligonucleotide
ttttacctgaagttaggagg

SEQ ID NO: 832 - DNA, 20 bp, Artificial sequence
  Synthetic Oligonucleotide
gtgattttacctgaagttag

SEQ ID NO: 833 - DNA, 20 bp, Artificial sequence
  Synthetic Oligonucleotide
atcagcaaggtgattttacc

SEQ ID NO: 834 - DNA, 20 bp, Artificial sequence
  Synthetic Oligonucleotide
tcatccaatatcagcaaggt

SEQ ID NO: 835 - DNA, 20 bp, Artificial sequence
  Synthetic Oligonucleotide
tcactttcttcatccaatat

SEQ ID NO: 836 - DNA, 20 bp, Artificial sequence
  Synthetic Oligonucleotide
atggcatcaaaaattaacat

SEQ ID NO: 837 - DNA, 20 bp, Artificial sequence
  Synthetic Oligonucleotide
catggcatcaaaaattaaca

SEQ ID NO: 838 - DNA, 20 bp, Artificial sequence
  Synthetic Oligonucleotide
tgcatggcatcaaaaattaa

SEQ ID NO: 839 - DNA, 20 bp, Artificial sequence
  Synthetic Oligonucleotide
agtgcatggcatcaaaaatt

SEQ ID NO: 840 - DNA, 20 bp, Artificial sequence
  Synthetic Oligonucleotide
tgagtgcatggcatcaaaaa

SEQ ID NO: 841 - DNA, 20 bp, Artificial sequence
  Synthetic Oligonucleotide
atgagtgcatggcatcaaaa

SEQ ID NO: 842 - DNA, 20 bp, Artificial sequence
  Synthetic Oligonucleotide
aaatgagtgcatggcatcaa

SEQ ID NO: 843 - DNA, 20 bp, Artificial sequence
  Synthetic Oligonucleotide
gaaatgagtgcatggcatca

SEQ ID NO: 844 - DNA, 20 bp, Artificial sequence
  Synthetic Oligonucleotide
ttggctggaaatgagtgcat

SEQ ID NO: 845 - DNA, 20 bp, Artificial sequence
  Synthetic Oligonucleotide
agtttctggacttcatcatt

SEQ ID NO: 846 - DNA, 20 bp, Artificial sequence
  Synthetic Oligonucleotide
ttgcatccaagtttctggac

SEQ ID NO: 847 - DNA, 20 bp, Artificial sequence
  Synthetic Oligonucleotide
tgtaaagctttgcatccaag

SEQ ID NO: 848 - DNA, 20 bp, Artificial sequence
  Synthetic Oligonucleotide
cctctgagactctctcaaac

SEQ ID NO: 849 - DNA, 20 bp, Artificial sequence
  Synthetic Oligonucleotide
tcagttgctcctctgagact

SEQ ID NO: 850 - DNA, 20 bp, Artificial sequence
  Synthetic Oligonucleotide
caaattcagtcagttgctcc

SEQ ID NO: 851 - DNA, 20 bp, Artificial sequence
  Synthetic Oligonucleotide
caatatcatataatctttgt

SEQ ID NO: 852 - DNA, 20 bp, Artificial sequence
  Synthetic Oligonucleotide
cgcacttaacaatatcatat

SEQ ID NO: 853 - DNA, 20 bp, Artificial sequence
  Synthetic Oligonucleotide
atttgttaacgcacttaaca

SEQ ID NO: 854 - DNA, 20 bp, Artificial sequence
  Synthetic Oligonucleotide
atctttaaaatttgttaacg

SEQ ID NO: 855 - DNA, 20 bp, Artificial sequence
  Synthetic Oligonucleotide
tgaagcacaatttcctcttc

SEQ ID NO: 856 - DNA, 20 bp, Artificial sequence
  Synthetic Oligonucleotide
tgcagcacatgaagcacaat

SEQ ID NO: 857 - DNA, 20 bp, Artificial sequence
  Synthetic Oligonucleotide
tgtaaacaatgcagcacatg

SEQ ID NO: 858 - DNA, 20 bp, Artificial sequence
  Synthetic Oligonucleotide
cattattgcaaggaatcgct

SEQ ID NO: 859 - DNA, 20 bp, Artificial sequence
  Synthetic Oligonucleotide
ggacttccacattattgcaa

SEQ ID NO: 860 - DNA, 20 bp, Artificial sequence
  Synthetic Oligonucleotide
cactcatgaggacttccaca

SEQ ID NO: 861 - DNA, 20 bp, Artificial sequence
  Synthetic Oligonucleotide
cacaatattataacacctga

SEQ ID NO: 862 - DNA, 20 bp, Artificial sequence
  Synthetic Oligonucleotide
tgctttcatagcttccacca

SEQ ID NO: 863 - DNA, 20 bp, Artificial sequence
  Synthetic Oligonucleotide
atgctttcatagcttccacc

SEQ ID NO: 864 - DNA, 20 bp, Artificial sequence
  Synthetic Oligonucleotide
gaatgctttcatagcttcca

SEQ ID NO: 865 - DNA, 20 bp, Artificial sequence
  Synthetic Oligonucleotide
gggaatgctttcatagcttc

SEQ ID NO: 866 - DNA, 20 bp, Artificial sequence
  Synthetic Oligonucleotide
tagggaatgctttcatagct

SEQ ID NO: 867 - DNA, 20 bp, Artificial sequence
  Synthetic Oligonucleotide
atagggaatgctttcatagc

SEQ ID NO: 868 - DNA, 20 bp, Artificial sequence
  Synthetic Oligonucleotide
tcatagggaatgctttcata

SEQ ID NO: 869 - DNA, 20 bp, Artificial sequence
  Synthetic Oligonucleotide
ctcatagggaatgctttcat

SEQ ID NO: 870 - DNA, 20 bp, Artificial sequence
  Synthetic Oligonucleotide
actcatagggaatgctttca

SEQ ID NO: 871 - DNA, 20 bp, Artificial sequence
  Synthetic Oligonucleotide
cactcatagggaatgctttc

SEQ ID NO: 872 - DNA, 20 bp, Artificial sequence
  Synthetic Oligonucleotide
tcactcatagggaatgcttt

SEQ ID NO: 873 - DNA, 20 bp, Artificial sequence
  Synthetic Oligonucleotide
ttcactcatagggaatgctt

SEQ ID NO: 874 - DNA, 20 bp, Artificial sequence
  Synthetic Oligonucleotide
tttcactcatagggaatgct

SEQ ID NO: 875 - DNA, 20 bp, Artificial sequence
  Synthetic Oligonucleotide
tctttcactcatagggaatg

SEQ ID NO: 876 - DNA, 20 bp, Artificial sequence
  Synthetic Oligonucleotide
ttctttcactcatagggaat

SEQ ID NO: 877 - DNA, 20 bp, Artificial sequence
  Synthetic Oligonucleotide
attctttcactcatagggaa

SEQ ID NO: 878 - DNA, 20 bp, Artificial sequence
  Synthetic Oligonucleotide
aattctttcactcataggga

SEQ ID NO: 879 - DNA, 20 bp, Artificial sequence
  Synthetic Oligonucleotide
gaattctttcactcataggg

SEQ ID NO: 880 - DNA, 20 bp, Artificial sequence
  Synthetic Oligonucleotide
tcttgaattctttcactcat

SEQ ID NO: 881 - DNA, 20 bp, Artificial sequence
  Synthetic Oligonucleotide
gcaactcacttcttgaattc

SEQ ID NO: 882 - DNA, 20 bp, Artificial sequence
  Synthetic Oligonucleotide
gagcaaacagcaactcactt

SEQ ID NO: 883 - DNA, 20 bp, Artificial sequence
  Synthetic Oligonucleotide
aaaaattacctaatgtaagc

SEQ ID NO: 884 - DNA, 20 bp, Artificial sequence
  Synthetic Oligonucleotide
ggatattgaaaaaattacct

SEQ ID NO: 885 - DNA, 20 bp, Artificial sequence
  Synthetic Oligonucleotide
ttaataccaggatattgaaa

SEQ ID NO: 886 - DNA, 20 bp, Artificial sequence
  Synthetic Oligonucleotide
accacaaactcatggacttc

SEQ ID NO: 887 - DNA, 20 bp, Artificial sequence
  Synthetic Oligonucleotide
caccacaaactcatggactt

SEQ ID NO: 888 - DNA, 20 bp, Artificial sequence
  Synthetic Oligonucleotide
tcaccacaaactcatggact

SEQ ID NO: 889 - DNA, 20 bp, Artificial sequence
  Synthetic Oligonucleotide
ttcaccacaaactcatggac

SEQ ID NO: 890 - DNA, 20 bp, Artificial sequence
  Synthetic Oligonucleotide
tttcaccacaaactcatgga

SEQ ID NO: 891 - DNA, 20 bp, Artificial sequence
  Synthetic Oligonucleotide
acagctttcaccacaaactc

SEQ ID NO: 892 - DNA, 20 bp, Artificial sequence
  Synthetic Oligonucleotide
tactgctgcacagctttcac

SEQ ID NO: 893 - DNA, 20 bp, Artificial sequence
  Synthetic Oligonucleotide
ttctctgggtactgctgcac

SEQ ID NO: 894 - DNA, 20 bp, Artificial sequence
  Synthetic Oligonucleotide
agggccaaacagctgagcgc

SEQ ID NO: 895 - DNA, 20 bp, Artificial sequence
  Synthetic Oligonucleotide
tcagtgaggagggccaaaca

SEQ ID NO: 896 - DNA, 20 bp, Artificial sequence
  Synthetic Oligonucleotide
ctaaatcttgatttaagaaa

SEQ ID NO: 897 - DNA, 20 bp, Artificial sequence
  Synthetic Oligonucleotide
tcttttcctctaaatcttga

SEQ ID NO: 898 - DNA, 20 bp, Artificial sequence
  Synthetic Oligonucleotide
cttgattctcattcttttcc

SEQ ID NO: 899 - DNA, 20 bp, Artificial sequence
  Synthetic Oligonucleotide
cttccccctcatcatcattc

SEQ ID NO: 900 - DNA, 20 bp, Artificial sequence
  Synthetic Oligonucleotide
atttatcttcttccccctca

SEQ ID NO: 901 - DNA, 20 bp, Artificial sequence
  Synthetic Oligonucleotide
gccaaaacaatttatcttct

SEQ ID NO: 902 - DNA, 20 bp, Artificial sequence
  Synthetic Oligonucleotide
cgttaatgctttgtaacagg

SEQ ID NO: 903 - DNA, 20 bp, Artificial sequence
  Synthetic Oligonucleotide
cttgttctttctatgccacg

SEQ ID NO: 904 - DNA, 20 bp, Artificial sequence
  Synthetic Oligonucleotide
ttagtgcccagcatgcggcc

SEQ ID NO: 905 - DNA, 20 bp, Artificial sequence
  Synthetic Oligonucleotide
ggagattatttagtgcccag

SEQ ID NO: 906 - DNA, 20 bp, Artificial sequence
  Synthetic Oligonucleotide
ggtacataaggagattattt

SEQ ID NO: 907 - DNA, 20 bp, Artificial sequence
  Synthetic Oligonucleotide
tccaatcttctcatgtaaac

SEQ ID NO: 908 - DNA, 20 bp, Artificial sequence
  Synthetic Oligonucleotide
atcttcatctccaatcttct

SEQ ID NO: 909 - DNA, 20 bp, Artificial sequence
  Synthetic Oligonucleotide
gaaatggccatcttcatctc

SEQ ID NO: 910 - DNA, 20 bp, Artificial sequence
  Synthetic Oligonucleotide
gagagcatcacttccctatg

SEQ ID NO: 911 - DNA, 20 bp, Artificial sequence
  Synthetic Oligonucleotide
atcagcatggagagcatcac

SEQ ID NO: 912 - DNA, 20 bp, Artificial sequence
  Synthetic Oligonucleotide
gaagaatgcatcagcatgga

SEQ ID NO: 913 - DNA, 20 bp, Artificial sequence
  Synthetic Oligonucleotide
cagatgcctggaaaacttcc

SEQ ID NO: 914 - DNA, 20 bp, Artificial sequence
  Synthetic Oligonucleotide
atgcattcgcagatgcctgg

SEQ ID NO: 915 - DNA, 20 bp, Artificial sequence
  Synthetic Oligonucleotide
gagttgacaatgcattcgca

SEQ ID NO: 916 - DNA, 20 bp, Artificial sequence
  Synthetic Oligonucleotide
tgttctaagagagttgacaa

SEQ ID NO: 917 - DNA, 20 bp, Artificial sequence
  Synthetic Oligonucleotide
gtattccttttgataacagt

SEQ ID NO: 918 - DNA, 20 bp, Artificial sequence
  Synthetic Oligonucleotide
cattcaggtgtattcctttt

SEQ ID NO: 919 - DNA, 20 bp, Artificial sequence
  Synthetic Oligonucleotide
actccaaaacattcaggtgt

SEQ ID NO: 920 - DNA, 20 bp, Artificial sequence
  Synthetic Oligonucleotide
aggagaatgtatatgcttct

SEQ ID NO: 921 - DNA, 20 bp, Artificial sequence
  Synthetic Oligonucleotide
agccacttcaggagaatgta

SEQ ID NO: 922 - DNA, 20 bp, Artificial sequence
  Synthetic Oligonucleotide
gccactttcagccacttcag

SEQ ID NO: 923 - DNA, 20 bp, Artificial sequence
  Synthetic Oligonucleotide
tcaaaaagatgatttagcat

SEQ ID NO: 924 - DNA, 20 bp, Artificial sequence
  Synthetic Oligonucleotide
ttgcttccttcaaaaagatg

SEQ ID NO: 925 - DNA, 20 bp, Artificial sequence
  Synthetic Oligonucleotide
cagggaagtgttgcttcctt

SEQ ID NO: 926 - DNA, 20 bp, Artificial sequence
  Synthetic Oligonucleotide
ataactgttagtattttggg

SEQ ID NO: 927 - DNA, 20 bp, Artificial sequence
  Synthetic Oligonucleotide
agctgcactggtaatgatgt

SEQ ID NO: 928 - DNA, 20 bp, Artificial sequence
  Synthetic Oligonucleotide
tgtaaaatagctcgaagcgc

SEQ ID NO: 929 - DNA, 20 bp, Artificial sequence
  Synthetic Oligonucleotide
ctggcatgccaggcactata

SEQ ID NO: 930 - DNA, 20 bp, Artificial sequence
  Synthetic Oligonucleotide
tggattcttctggcatgcca

SEQ ID NO: 931 - DNA, 20 bp, Artificial sequence
  Synthetic Oligonucleotide
tatcctccctggattcttct

SEQ ID NO: 932 - DNA, 20 bp, Artificial sequence
  Synthetic Oligonucleotide
ccatatttagcttatgatga

SEQ ID NO: 933 - DNA, 20 bp, Artificial sequence
  Synthetic Oligonucleotide
gttttttaaccatatttagc

SEQ ID NO: 934 - DNA, 20 bp, Artificial sequence
  Synthetic Oligonucleotide
tgaaacactgttttttaacc

SEQ ID NO: 935 - DNA, 20 bp, Artificial sequence
  Synthetic Oligonucleotide
taggaccagtttgtgaatat

SEQ ID NO: 936 - DNA, 20 bp, Artificial sequence
  Synthetic Oligonucleotide
caaagctgctaggaccagtt

SEQ ID NO: 937 - DNA, 20 bp, Artificial sequence
  Synthetic Oligonucleotide
gaacctgttcaaagctgcta

SEQ ID NO: 938 - DNA, 20 bp, Artificial sequence
  Synthetic Oligonucleotide
atttccaatgaacctgttca

SEQ ID NO: 939 - DNA, 20 bp, Artificial sequence
  Synthetic Oligonucleotide
ttctgaatcccaggatttcc

SEQ ID NO: 940 - DNA, 20 bp, Artificial sequence
  Synthetic Oligonucleotide
tttctgaatcccaggatttc

SEQ ID NO: 941 - DNA, 20 bp, Artificial sequence
  Synthetic Oligonucleotide
catttctgaatcccaggatt

SEQ ID NO: 942 - DNA, 20 bp, Artificial sequence
  Synthetic Oligonucleotide
acatttctgaatcccaggat

SEQ ID NO: 943 - DNA, 20 bp, Artificial sequence
  Synthetic Oligonucleotide
ccacatttctgaatcccagg

SEQ ID NO: 944 - DNA, 20 bp, Artificial sequence
  Synthetic Oligonucleotide
atccacatttctgaatccca

SEQ ID NO: 945 - DNA, 20 bp, Artificial sequence
  Synthetic Oligonucleotide
taatccacatttctgaatcc

SEQ ID NO: 946 - DNA, 20 bp, Artificial sequence
  Synthetic Oligonucleotide
agaaattacttttaatccac

SEQ ID NO: 947 - DNA, 20 bp, Artificial sequence
  Synthetic Oligonucleotide
tacaatagaagaaattactt

SEQ ID NO: 948 - DNA, 20 bp, Artificial sequence
  Synthetic Oligonucleotide
tctaatgcatcaggaaaatg

SEQ ID NO: 949 - DNA, 20 bp, Artificial sequence
  Synthetic Oligonucleotide
gataacatctctaatgcatc

SEQ ID NO: 950 - DNA, 20 bp, Artificial sequence
  Synthetic Oligonucleotide
ccttccagggataacatctc

SEQ ID NO: 951 - DNA, 20 bp, Artificial sequence
  Synthetic Oligonucleotide
tccatagcaccttccaggga

SEQ ID NO: 952 - DNA, 20 bp, Artificial sequence
  Synthetic Oligonucleotide
actgaatccatagcaccttc

SEQ ID NO: 953 - DNA, 20 bp, Artificial sequence
  Synthetic Oligonucleotide
cactgaatccatagcacctt

SEQ ID NO: 954 - DNA, 20 bp, Artificial sequence
  Synthetic Oligonucleotide
gcactgaatccatagcacct

SEQ ID NO: 955 - DNA, 20 bp, Artificial sequence
  Synthetic Oligonucleotide
agcactgaatccatagcacc

SEQ ID NO: 956 - DNA, 20 bp, Artificial sequence
  Synthetic Oligonucleotide
aagcactgaatccatagcac

SEQ ID NO: 957 - DNA, 20 bp, Artificial sequence
  Synthetic Oligonucleotide
tgaagcactgaatccatagc

SEQ ID NO: 958 - DNA, 20 bp, Artificial sequence
  Synthetic Oligonucleotide
gtgaagcactgaatccatag

SEQ ID NO: 959 - DNA, 20 bp, Artificial sequence
  Synthetic Oligonucleotide
tgtgaagcactgaatccata

SEQ ID NO: 960 - DNA, 20 bp, Artificial sequence
  Synthetic Oligonucleotide
gtgtgaagcactgaatccat

SEQ ID NO: 961 - DNA, 20 bp, Artificial sequence
  Synthetic Oligonucleotide
tgtgtgaagcactgaatcca

SEQ ID NO: 962 - DNA, 20 bp, Artificial sequence
  Synthetic Oligonucleotide
gcagtgtgtgaagcactgaa

SEQ ID NO: 963 - DNA, 20 bp, Artificial sequence
  Synthetic Oligonucleotide
gatacatctgcagtgtgtga

SEQ ID NO: 964 - DNA, 20 bp, Artificial sequence
  Synthetic Oligonucleotide
ggtcatctggatacatctgc

SEQ ID NO: 965 - DNA, 20 bp, Artificial sequence
  Synthetic Oligonucleotide
gaatttcttggtcatctgga

SEQ ID NO: 966 - DNA, 20 bp, Artificial sequence
  Synthetic Oligonucleotide
agacttaaacccagacactg

SEQ ID NO: 967 - DNA, 20 bp, Artificial sequence
  Synthetic Oligonucleotide
tatcctataagacttaaacc

SEQ ID NO: 968 - DNA, 20 bp, Artificial sequence
  Synthetic Oligonucleotide
gtaatcaagtatcctataag

SEQ ID NO: 969 - DNA, 20 bp, Artificial sequence
  Synthetic Oligonucleotide
cagttcctatgaacacattc

SEQ ID NO: 970 - DNA, 20 bp, Artificial sequence
  Synthetic Oligonucleotide
gcagatgtccagttcctatg

SEQ ID NO: 971 - DNA, 20 bp, Artificial sequence
  Synthetic Oligonucleotide
tttttgccagcagatgtcca

SEQ ID NO: 972 - DNA, 20 bp, Artificial sequence
  Synthetic Oligonucleotide
aaaccagaatttttgccagc

SEQ ID NO: 973 - DNA, 20 bp, Artificial sequence
  Synthetic Oligonucleotide
ttaaatcggtataagctgga

SEQ ID NO: 974 - DNA, 20 bp, Artificial sequence
  Synthetic Oligonucleotide
gcaacatccttaaatcggta

SEQ ID NO: 975 - DNA, 20 bp, Artificial sequence
  Synthetic Oligonucleotide
tgtatttcagcaacatcctt

SEQ ID NO: 976 - DNA, 20 bp, Artificial sequence
  Synthetic Oligonucleotide
ctaagattgtctgaaatcct

SEQ ID NO: 977 - DNA, 20 bp, Artificial sequence
  Synthetic Oligonucleotide
tgaggattgctaagattgtc

SEQ ID NO: 978 - DNA, 20 bp, Artificial sequence
  Synthetic Oligonucleotide
ctgacaatttgaggattgct

SEQ ID NO: 979 - DNA, 20 bp, Artificial sequence
  Synthetic Oligonucleotide
atgcaccagcagcttagaaa

SEQ ID NO: 980 - DNA, 20 bp, Artificial sequence
  Synthetic Oligonucleotide
aaatgaatgatgcaccagca

SEQ ID NO: 981 - DNA, 20 bp, Artificial sequence
  Synthetic Oligonucleotide
tactaagtcaaatgaatgat

SEQ ID NO: 982 - DNA, 20 bp, Artificial sequence
  Synthetic Oligonucleotide
gatattggaagacatttgat

SEQ ID NO: 983 - DNA, 20 bp, Artificial sequence
  Synthetic Oligonucleotide
ttgttccatgatattggaag

SEQ ID NO: 984 - DNA, 20 bp, Artificial sequence
  Synthetic Oligonucleotide
tttagaaactgttgatcctt

SEQ ID NO: 985 - DNA, 20 bp, Artificial sequence
  Synthetic Oligonucleotide
gtttagaaactgttgatcct

SEQ ID NO: 986 - DNA, 20 bp, Artificial sequence
  Synthetic Oligonucleotide
ggtttagaaactgttgatcc

SEQ ID NO: 987 - DNA, 20 bp, Artificial sequence
  Synthetic Oligonucleotide
aggtttagaaactgttgatc

SEQ ID NO: 988 - DNA, 20 bp, Artificial sequence
  Synthetic Oligonucleotide
gaggtttagaaactgttgat

SEQ ID NO: 989 - DNA, 20 bp, Artificial sequence
  Synthetic Oligonucleotide
cagaggtttagaaactgttg

SEQ ID NO: 990 - DNA, 20 bp, Artificial sequence
  Synthetic Oligonucleotide
acagaggtttagaaactgtt

SEQ ID NO: 991 - DNA, 20 bp, Artificial sequence
  Synthetic Oligonucleotide
aacagaggtttagaaactgt

SEQ ID NO: 992 - DNA, 20 bp, Artificial sequence
  Synthetic Oligonucleotide
caacagaggtttagaaactg

SEQ ID NO: 993 - DNA, 20 bp, Artificial sequence
  Synthetic Oligonucleotide
gcaacagaggtttagaaact

SEQ ID NO: 994 - DNA, 20 bp, Artificial sequence
  Synthetic Oligonucleotide
acttgcaacagaggtttaga

SEQ ID NO: 995 - DNA, 20 bp, Artificial sequence
  Synthetic Oligonucleotide
ttgcaaaacacttgcaacag

SEQ ID NO: 996 - DNA, 20 bp, Artificial sequence
  Synthetic Oligonucleotide
tagctacttttgcaaaacac

SEQ ID NO: 997 - DNA, 20 bp, Artificial sequence
  Synthetic Oligonucleotide
catcacattttttaagtaat

SEQ ID NO: 998 - DNA, 20 bp, Artificial sequence
  Synthetic Oligonucleotide
tctctctagcatcacatttt

SEQ ID NO: 999 - DNA, 20 bp, Artificial sequence
  Synthetic Oligonucleotide
atcacacgctctctctagca

SEQ ID NO: 1000 - DNA, 20 bp, Artificial sequence
  Synthetic Oligonucleotide
agaagcaagcattcaaccat

SEQ ID NO: 1001 - DNA, 20 bp, Artificial sequence
  Synthetic Oligonucleotide
gctcccaatagaagcaagca

SEQ ID NO: 1002 - DNA, 20 bp, Artificial sequence
  Synthetic Oligonucleotide
tgattggcatctgctcccaa

SEQ ID NO: 1003 - DNA, 20 bp, Artificial sequence
  Synthetic Oligonucleotide
ttgattggcatctgctccca

SEQ ID NO: 1004 - DNA, 20 bp, Artificial sequence
  Synthetic Oligonucleotide
cttgattggcatctgctccc

SEQ ID NO: 1005 - DNA, 20 bp, Artificial sequence
  Synthetic Oligonucleotide
gcttgattggcatctgctcc

SEQ ID NO: 1006 - DNA, 20 bp, Artificial sequence
  Synthetic Oligonucleotide
tgcttgattggcatctgctc

SEQ ID NO: 1007 - DNA, 20 bp, Artificial sequence
  Synthetic Oligonucleotide
ctttgcttgattggcatctg

SEQ ID NO: 1008 - DNA, 20 bp, Artificial sequence
  Synthetic Oligonucleotide
cctttgcttgattggcatct

SEQ ID NO: 1009 - DNA, 20 bp, Artificial sequence
  Synthetic Oligonucleotide
tcctttgcttgattggcatc

SEQ ID NO: 1010 - DNA, 20 bp, Artificial sequence
  Synthetic Oligonucleotide
ctcctttgcttgattggcat

SEQ ID NO: 1011 - DNA, 20 bp, Artificial sequence
  Synthetic Oligonucleotide
atccctcctttgcttgattg

SEQ ID NO: 1012 - DNA, 20 bp, Artificial sequence
  Synthetic Oligonucleotide
ttaaagaagatccctccttt

SEQ ID NO: 1013 - DNA, 20 bp, Artificial sequence
  Synthetic Oligonucleotide
cctgacaaattaaagaagat

SEQ ID NO: 1014 - DNA, 20 bp, Artificial sequence
  Synthetic Oligonucleotide
tctttctcacatacctgaca

SEQ ID NO: 1015 - DNA, 20 bp, Artificial sequence
  Synthetic Oligonucleotide
ctctttctcacatacctgac

SEQ ID NO: 1016 - DNA, 20 bp, Artificial sequence
  Synthetic Oligonucleotide
ctctctttctcacatacctg

SEQ ID NO: 1017 - DNA, 20 bp, Artificial sequence
  Synthetic Oligonucleotide
gactgctctctttctcacat

SEQ ID NO: 1018 - DNA, 20 bp, Artificial sequence
  Synthetic Oligonucleotide
gggactgctctctttctcac

SEQ ID NO: 1019 - DNA, 20 bp, Artificial sequence
  Synthetic Oligonucleotide
ttgggactgctctctttctc

SEQ ID NO: 1020 - DNA, 20 bp, Artificial sequence
  Synthetic Oligonucleotide
tttgggactgctctctttct

SEQ ID NO: 1021 - DNA, 20 bp, Artificial sequence
  Synthetic Oligonucleotide
aatttgggactgctctcttt

SEQ ID NO: 1022 - DNA, 20 bp, Artificial sequence
  Synthetic Oligonucleotide
caatttgggactgctctctt

SEQ ID NO: 1023 - DNA, 20 bp, Artificial sequence
  Synthetic Oligonucleotide
tcagtaagagttccaccaat

SEQ ID NO: 1024 - DNA, 20 bp, Artificial sequence
  Synthetic Oligonucleotide
tacatcttgttcacgagatc

SEQ ID NO: 1025 - DNA, 20 bp, Artificial sequence
  Synthetic Oligonucleotide
gatctggctgtcacctttcc

SEQ ID NO: 1026 - DNA, 20 bp, Artificial sequence
  Synthetic Oligonucleotide
caagctgatgatctggctgt

SEQ ID NO: 1027 - DNA, 20 bp, Artificial sequence
  Synthetic Oligonucleotide
ccttaagagcaagctgatga

SEQ ID NO: 1028 - DNA, 20 bp, Artificial sequence
  Synthetic Oligonucleotide
ggccagcctccttaagagca

SEQ ID NO: 1029 - DNA, 20 bp, Artificial sequence
  Synthetic Oligonucleotide
gctattgttggccacatcca

SEQ ID NO: 1030 - DNA, 20 bp, Artificial sequence
  Synthetic Oligonucleotide
aaggcaaatgctattgttgg

SEQ ID NO: 1031 - DNA, 20 bp, Artificial sequence
  Synthetic Oligonucleotide
aaatcctccaaggcaaatgc

SEQ ID NO: 1032 - DNA, 20 bp, Artificial sequence
  Synthetic Oligonucleotide
caagaaggttcaacttttcc

SEQ ID NO: 1033 - DNA, 20 bp, Artificial sequence
  Synthetic Oligonucleotide
gtttccttaaattagaagtc

SEQ ID NO: 1034 - DNA, 20 bp, Artificial sequence
  Synthetic Oligonucleotide
atatttgtttgtttccttaa

SEQ ID NO: 1035 - DNA, 20 bp, Artificial sequence
  Synthetic Oligonucleotide
gtagatgctatatttgtttg

SEQ ID NO: 1036 - DNA, 20 bp, Artificial sequence
  Synthetic Oligonucleotide
gatatctgatcaccattctt

SEQ ID NO: 1037 - DNA, 20 bp, Artificial sequence
  Synthetic Oligonucleotide
ttttcatctgatatctgatc

SEQ ID NO: 1038 - DNA, 20 bp, Artificial sequence
  Synthetic Oligonucleotide
ccacagcacttttcatctga

SEQ ID NO: 1039 - DNA, 20 bp, Artificial sequence
  Synthetic Oligonucleotide
ttccttcttccacagcactt

SEQ ID NO: 1040 - DNA, 20 bp, Artificial sequence
  Synthetic Oligonucleotide
ccatcgctgcctgaggctgt

SEQ ID NO: 1041 - DNA, 20 bp, Artificial sequence
  Synthetic Oligonucleotide
gaaaaatttccatcgctgcc

SEQ ID NO: 1042 - DNA, 20 bp, Artificial sequence
  Synthetic Oligonucleotide
acatcttcagaaaaatttcc

SEQ ID NO: 1043 - DNA, 20 bp, Artificial sequence
  Synthetic Oligonucleotide
aggtccattcatcaaattta

SEQ ID NO: 1044 - DNA, 20 bp, Artificial sequence
  Synthetic Oligonucleotide
caggaataaaggtccattca

SEQ ID NO: 1045 - DNA, 20 bp, Artificial sequence
  Synthetic Oligonucleotide
tagaagagtcaggaataaag

SEQ ID NO: 1046 - DNA, 20 bp, Artificial sequence
  Synthetic Oligonucleotide
acacactgtccatagaagag

SEQ ID NO: 1047 - DNA, 20 bp, Artificial sequence
  Synthetic Oligonucleotide
aaacacactgtccatagaag

SEQ ID NO: 1048 - DNA, 20 bp, Artificial sequence
  Synthetic Oligonucleotide
gcaaacacactgtccataga

SEQ ID NO: 1049 - DNA, 20 bp, Artificial sequence
  Synthetic Oligonucleotide
gagcaaacacactgtccata

SEQ ID NO: 1050 - DNA, 20 bp, Artificial sequence
  Synthetic Oligonucleotide
tgagcaaacacactgtccat

SEQ ID NO: 1051 - DNA, 20 bp, Artificial sequence
  Synthetic Oligonucleotide
tttgagcaaacacactgtcc

SEQ ID NO: 1052 - DNA, 20 bp, Artificial sequence
  Synthetic Oligonucleotide
ctttgagcaaacacactgtc

SEQ ID NO: 1053 - DNA, 20 bp, Artificial sequence
  Synthetic Oligonucleotide
gtcatcactttgagcaaaca

SEQ ID NO: 1054 - DNA, 20 bp, Artificial sequence
  Synthetic Oligonucleotide
actatccaggtcatcacttt

SEQ ID NO: 1055 - DNA, 20 bp, Artificial sequence
  Synthetic Oligonucleotide
acttccttcactatccaggt

SEQ ID NO: 1056 - DNA, 20 bp, Artificial sequence
  Synthetic Oligonucleotide
tttttcacaagaaatgagcc

SEQ ID NO: 1057 - DNA, 20 bp, Artificial sequence
  Synthetic Oligonucleotide
ttagatttctttttcacaag

SEQ ID NO: 1058 - DNA, 20 bp, Artificial sequence
  Synthetic Oligonucleotide
ctaattgaattagatttctt

SEQ ID NO: 1059 - DNA, 20 bp, Artificial sequence
  Synthetic Oligonucleotide
cggcatctcggtaaaattct

SEQ ID NO: 1060 - DNA, 20 bp, Artificial sequence
  Synthetic Oligonucleotide
gctgtaatacggcatctcgg

SEQ ID NO: 1061 - DNA, 20 bp, Artificial sequence
  Synthetic Oligonucleotide
ggaattggaatgtctttgca

SEQ ID NO: 1062 - DNA, 20 bp, Artificial sequence
  Synthetic Oligonucleotide
gggccccaaggaattggaat

SEQ ID NO: 1063 - DNA, 20 bp, Artificial sequence
  Synthetic Oligonucleotide
atcaaaaatgggccccaagg

SEQ ID NO: 1064 - DNA, 20 bp, Artificial sequence
  Synthetic Oligonucleotide
ctttttcgcttcagtaaatc

SEQ ID NO: 1065 - DNA, 20 bp, Artificial sequence
  Synthetic Oligonucleotide
ataatatttttctttttcgc

SEQ ID NO: 1066 - DNA, 20 bp, Artificial sequence
  Synthetic Oligonucleotide
catctgaagataatattttt

SEQ ID NO: 1067 - DNA, 20 bp, Artificial sequence
  Synthetic Oligonucleotide
gaagttttgatgacctgagt

SEQ ID NO: 1068 - DNA, 20 bp, Artificial sequence
  Synthetic Oligonucleotide
tatgggattgaagttttgat

SEQ ID NO: 1069 - DNA, 20 bp, Artificial sequence
  Synthetic Oligonucleotide
aatgcctcatatgggattga

SEQ ID NO: 1070 - DNA, 20 bp, Artificial sequence
  Synthetic Oligonucleotide
tgctgtctgaatgcctcata

SEQ ID NO: 1071 - DNA, 20 bp, Artificial sequence
  Synthetic Oligonucleotide
cagaagccagagaagaaatg

SEQ ID NO: 1072 - DNA, 20 bp, Artificial sequence
  Synthetic Oligonucleotide
attctctctcagaagccaga

SEQ ID NO: 1073 - DNA, 20 bp, Artificial sequence
  Synthetic Oligonucleotide
atgtaatatattctctctca

SEQ ID NO: 1074 - DNA, 20 bp, Artificial sequence
  Synthetic Oligonucleotide
tagttcatttgctgaaaggt

SEQ ID NO: 1075 - DNA, 20 bp, Artificial sequence
  Synthetic Oligonucleotide
aatatctcttagttcatttg

SEQ ID NO: 1076 - DNA, 20 bp, Artificial sequence
  Synthetic Oligonucleotide
tagggcatcaatatctctta

SEQ ID NO: 1077 - DNA, 20 bp, Artificial sequence
  Synthetic Oligonucleotide
tttctggcttagggcatcaa

SEQ ID NO: 1078 - DNA, 20 bp, Artificial sequence
  Synthetic Oligonucleotide
atgaacacttatacagcatt

SEQ ID NO: 1079 - DNA, 20 bp, Artificial sequence
  Synthetic Oligonucleotide
atgctccaaatgaacactta

SEQ ID NO: 1080 - DNA, 20 bp, Artificial sequence
  Synthetic Oligonucleotide
cttttcaagatgctccaaat

SEQ ID NO: 1081 - DNA, 20 bp, Artificial sequence
  Synthetic Oligonucleotide
gtgagtgcattctggtgaag

SEQ ID NO: 1082 - DNA, 20 bp, Artificial sequence
  Synthetic Oligonucleotide
tagctgttgtggaaagctcg

SEQ ID NO: 1083 - DNA, 20 bp, Artificial sequence
  Synthetic Oligonucleotide
gtgtcaaactcttcagagtt

SEQ ID NO: 1084 - DNA, 20 bp, Artificial sequence
  Synthetic Oligonucleotide
tgtgtcaaactcttcagagt

SEQ ID NO: 1085 - DNA, 20 bp, Artificial sequence
  Synthetic Oligonucleotide
atgtgtcaaactcttcagag

SEQ ID NO: 1086 - DNA, 20 bp, Artificial sequence
  Synthetic Oligonucleotide
aatgtgtcaaactcttcaga

SEQ ID NO: 1087 - DNA, 20 bp, Artificial sequence
  Synthetic Oligonucleotide
agtccaaatgtgtcaaactc

SEQ ID NO: 1088 - DNA, 20 bp, Artificial sequence
  Synthetic Oligonucleotide
tactgtgcaagtccaaatgt

SEQ ID NO: 1089 - DNA, 20 bp, Artificial sequence
  Synthetic Oligonucleotide
taaatttattactgtgcaag

SEQ ID NO: 1090 - DNA, 20 bp, Artificial sequence
  Synthetic Oligonucleotide
acaaataagaaggaaatgat

SEQ ID NO: 1091 - DNA, 20 bp, Artificial sequence
  Synthetic Oligonucleotide
tcattttcaacaaataagaa

SEQ ID NO: 1092 - DNA, 20 bp, Artificial sequence
  Synthetic Oligonucleotide
caatacaactcattttcaac

SEQ ID NO: 1093 - DNA, 20 bp, Artificial sequence
  Synthetic Oligonucleotide
gtcatttcgagagacatcaa

SEQ ID NO: 1094 - DNA, 20 bp, Artificial sequence
  Synthetic Oligonucleotide
gggtccaatgtcatttcgag

SEQ ID NO: 1095 - DNA, 20 bp, Artificial sequence
  Synthetic Oligonucleotide
aaccactgagggtccaatgt

SEQ ID NO: 1096 - DNA, 20 bp, Artificial sequence
  Synthetic Oligonucleotide
gttggacatttcactgtagg

SEQ ID NO: 1097 - DNA, 20 bp, Artificial sequence
  Synthetic Oligonucleotide
tgtttcagagttggacattt

SEQ ID NO: 1098 - DNA, 20 bp, Artificial sequence
  Synthetic Oligonucleotide
aggttaaactgtttcagagt

SEQ ID NO: 1099 - DNA, 20 bp, Artificial sequence
  Synthetic Oligonucleotide
ttatatgacaggttaaactg

SEQ ID NO: 1100 - DNA, 20 bp, Artificial sequence
  Synthetic Oligonucleotide
ggtacaaaagacagctggtt

SEQ ID NO: 1101 - DNA, 20 bp, Artificial sequence
  Synthetic Oligonucleotide
aggttctcaggtacaaaaga

SEQ ID NO: 1102 - DNA, 20 bp, Artificial sequence
  Synthetic Oligonucleotide
acatcagtgaggttctcagg

SEQ ID NO: 1103 - DNA, 20 bp, Artificial sequence
  Synthetic Oligonucleotide
aaatgagctgctccagtttc

SEQ ID NO: 1104 - DNA, 20 bp, Artificial sequence
  Synthetic Oligonucleotide
ttccttctaaaatgagctgc

SEQ ID NO: 1105 - DNA, 20 bp, Artificial sequence
  Synthetic Oligonucleotide
ctgatattttatttccttct

SEQ ID NO: 1106 - DNA, 20 bp, Artificial sequence
  Synthetic Oligonucleotide
agcatatccctgatatttta

SEQ ID NO: 1107 - DNA, 20 bp, Artificial sequence
  Synthetic Oligonucleotide
cagttccttcagtctcaagg

SEQ ID NO: 1108 - DNA, 20 bp, Artificial sequence
  Synthetic Oligonucleotide
tcagttccttcagtctcaag

SEQ ID NO: 1109 - DNA, 20 bp, Artificial sequence
  Synthetic Oligonucleotide
ttcagttccttcagtctcaa

SEQ ID NO: 1110 - DNA, 20 bp, Artificial sequence
  Synthetic Oligonucleotide
cttcagttccttcagtctca

SEQ ID NO: 1111 - DNA, 20 bp, Artificial sequence
  Synthetic Oligonucleotide
tcttcagttccttcagtctc

SEQ ID NO: 1112 - DNA, 20 bp, Artificial sequence
  Synthetic Oligonucleotide
ttaaaatcttcagttccttc

SEQ ID NO: 1113 - DNA, 20 bp, Artificial sequence
  Synthetic Oligonucleotide
tactaaggtttaaaatcttc

SEQ ID NO: 1114 - DNA, 20 bp, Artificial sequence
  Synthetic Oligonucleotide
tgtggttcttactaaggttt

SEQ ID NO: 1115 - DNA, 20 bp, Artificial sequence
  Synthetic Oligonucleotide
gaaagttctctgatagggat

SEQ ID NO: 1116 - DNA, 20 bp, Artificial sequence
  Synthetic Oligonucleotide
aagcctcaagaaagttctct

SEQ ID NO: 1117 - DNA, 20 bp, Artificial sequence
  Synthetic Oligonucleotide
attcattctggcactgaaac

SEQ ID NO: 1118 - DNA, 20 bp, Artificial sequence
  Synthetic Oligonucleotide
agcaagaaaattcattctgg

SEQ ID NO: 1119 - DNA, 20 bp, Artificial sequence
  Synthetic Oligonucleotide
aggcatagcagcaagaaaat

SEQ ID NO: 1120 - DNA, 20 bp, Artificial sequence
  Synthetic Oligonucleotide
aggattgtcatagaaggagg

SEQ ID NO: 1121 - DNA, 20 bp, Artificial sequence
  Synthetic Oligonucleotide
gataattttaggattgtcat

SEQ ID NO: 1122 - DNA, 20 bp, Artificial sequence
  Synthetic Oligonucleotide
tttgttctgagataatttta

SEQ ID NO: 1123 - DNA, 20 bp, Artificial sequence
  Synthetic Oligonucleotide
aaattgcttctggaatacag

SEQ ID NO: 1124 - DNA, 20 bp, Artificial sequence
  Synthetic Oligonucleotide
gaagatttaaaattgcttct

SEQ ID NO: 1125 - DNA, 20 bp, Artificial sequence
  Synthetic Oligonucleotide
gcaagtgtggaagatttaaa

SEQ ID NO: 1126 - DNA, 20 bp, Artificial sequence
  Synthetic Oligonucleotide
tatctaaagaccgcaagtgt

SEQ ID NO: 1127 - DNA, 20 bp, Artificial sequence
  Synthetic Oligonucleotide
atatctaaagaccgcaagtg

SEQ ID NO: 1128 - DNA, 20 bp, Artificial sequence
  Synthetic Oligonucleotide
catatctaaagaccgcaagt

SEQ ID NO: 1129 - DNA, 20 bp, Artificial sequence
  Synthetic Oligonucleotide
tcatatctaaagaccgcaag

SEQ ID NO: 1130 - DNA, 20 bp, Artificial sequence
  Synthetic Oligonucleotide
ctcatatctaaagaccgcaa

SEQ ID NO: 1131 - DNA, 20 bp, Artificial sequence
  Synthetic Oligonucleotide
tgctcatatctaaagaccgc

SEQ ID NO: 1132 - DNA, 20 bp, Artificial sequence
  Synthetic Oligonucleotide
ctgctcatatctaaagaccg

SEQ ID NO: 1133 - DNA, 20 bp, Artificial sequence
  Synthetic Oligonucleotide
gctgctcatatctaaagacc

SEQ ID NO: 1134 - DNA, 20 bp, Artificial sequence
  Synthetic Oligonucleotide
tgctgctcatatctaaagac

SEQ ID NO: 1135 - DNA, 20 bp, Artificial sequence
  Synthetic Oligonucleotide
ttgctgctcatatctaaaga

SEQ ID NO: 1136 - DNA, 20 bp, Artificial sequence
  Synthetic Oligonucleotide
atcattgctgctcatatcta

SEQ ID NO: 1137 - DNA, 20 bp, Artificial sequence
  Synthetic Oligonucleotide
gtactgaatatcattgctgc

SEQ ID NO: 1138 - DNA, 20 bp, Artificial sequence
  Synthetic Oligonucleotide
acctggtaggtactgaatat

SEQ ID NO: 1139 - DNA, 20 bp, Artificial sequence
  Synthetic Oligonucleotide
aagttcaaagatttccagtg

SEQ ID NO: 1140 - DNA, 20 bp, Artificial sequence
  Synthetic Oligonucleotide
agttcccttaagttcaaaga

SEQ ID NO: 1141 - DNA, 20 bp, Artificial sequence
  Synthetic Oligonucleotide
ctaaataagagttcccttaa

SEQ ID NO: 1142 - DNA, 20 bp, Artificial sequence
  Synthetic Oligonucleotide
agtccaagatgctgatctga

SEQ ID NO: 1143 - DNA, 20 bp, Artificial sequence
  Synthetic Oligonucleotide
tttcactcaagtccaagatg

SEQ ID NO: 1144 - DNA, 20 bp, Artificial sequence
  Synthetic Oligonucleotide
aatatgctttttcactcaag

SEQ ID NO: 1145 - DNA, 20 bp, Artificial sequence
  Synthetic Oligonucleotide
atgcagtttctctactctag

SEQ ID NO: 1146 - DNA, 20 bp, Artificial sequence
  Synthetic Oligonucleotide
gtgagaaagatgcagtttct

SEQ ID NO: 1147 - DNA, 20 bp, Artificial sequence
  Synthetic Oligonucleotide
cagtttattgtgagaaagat

SEQ ID NO: 1148 - DNA, 20 bp, Artificial sequence
  Synthetic Oligonucleotide
aatctctttcagtttattgt

SEQ ID NO: 1149 - DNA, 20 bp, Artificial sequence
  Synthetic Oligonucleotide
acagccaatctcaggaggaa

SEQ ID NO: 1150 - DNA, 20 bp, Artificial sequence
  Synthetic Oligonucleotide
attttcaagacagccaatct

SEQ ID NO: 1151 - DNA, 20 bp, Artificial sequence
  Synthetic Oligonucleotide
agatgtcagattttcaagac

SEQ ID NO: 1152 - DNA, 20 bp, Artificial sequence
  Synthetic Oligonucleotide
aaggatcttagttccaagtt

SEQ ID NO: 1153 - DNA, 20 bp, Artificial sequence
  Synthetic Oligonucleotide
tcattgggaaaggatcttag

SEQ ID NO: 1154 - DNA, 20 bp, Artificial sequence
  Synthetic Oligonucleotide
cccatattttgcttaatttc

SEQ ID NO: 1155 - DNA, 20 bp, Artificial sequence
  Synthetic Oligonucleotide
aaggaagatcccatattttg

SEQ ID NO: 1156 - DNA, 20 bp, Artificial sequence
  Synthetic Oligonucleotide
gttcatccaaaggaagatcc

SEQ ID NO: 1157 - DNA, 20 bp, Artificial sequence
  Synthetic Oligonucleotide
tatgtttaaaatcaaagtta

SEQ ID NO: 1158 - DNA, 20 bp, Artificial sequence
  Synthetic Oligonucleotide
tacatcctatatgtttaaaa

SEQ ID NO: 1159 - DNA, 20 bp, Artificial sequence
  Synthetic Oligonucleotide
ttatgatgtctttggcttta

SEQ ID NO: 1160 - DNA, 20 bp, Artificial sequence
  Synthetic Oligonucleotide
cttatgatgtctttggcttt

SEQ ID NO: 1161 - DNA, 20 bp, Artificial sequence
  Synthetic Oligonucleotide
accttatgatgtctttggct

SEQ ID NO: 1162 - DNA, 20 bp, Artificial sequence
  Synthetic Oligonucleotide
aaaccttatgatgtctttgg

SEQ ID NO: 1163 - DNA, 20 bp, Artificial sequence
  Synthetic Oligonucleotide
aagaaaccttatgatgtctt

SEQ ID NO: 1164 - DNA, 20 bp, Artificial sequence
  Synthetic Oligonucleotide
atcgctgttgaagaaacctt

SEQ ID NO: 1165 - DNA, 20 bp, Artificial sequence
  Synthetic Oligonucleotide
ccttttttaatcgctgttga

SEQ ID NO: 1166 - DNA, 20 bp, Artificial sequence
  Synthetic Oligonucleotide
aaggcacagccttttttaat

SEQ ID NO: 1167 - DNA, 20 bp, Artificial sequence
  Synthetic Oligonucleotide
attcggttataaggcacagc

SEQ ID NO: 1168 - DNA, 20 bp, Artificial sequence
  Synthetic Oligonucleotide
cattcggttataaggcacag

SEQ ID NO: 1169 - DNA, 20 bp, Artificial sequence
  Synthetic Oligonucleotide
tcattcggttataaggcaca

SEQ ID NO: 1170 - DNA, 20 bp, Artificial sequence
  Synthetic Oligonucleotide
ttcattcggttataaggcac

SEQ ID NO: 1171 - DNA, 20 bp, Artificial sequence
  Synthetic Oligonucleotide
tttcattcggttataaggca

SEQ ID NO: 1172 - DNA, 20 bp, Artificial sequence
  Synthetic Oligonucleotide
agtttcattcggttataagg

SEQ ID NO: 1173 - DNA, 20 bp, Artificial sequence
  Synthetic Oligonucleotide
aagtttcattcggttataag

SEQ ID NO: 1174 - DNA, 20 bp, Artificial sequence
  Synthetic Oligonucleotide
taagtttcattcggttataa

SEQ ID NO: 1175 - DNA, 20 bp, Artificial sequence
  Synthetic Oligonucleotide
ataagtttcattcggttata

SEQ ID NO: 1176 - DNA, 20 bp, Artificial sequence
  Synthetic Oligonucleotide
cataagtttcattcggttat

SEQ ID NO: 1177 - DNA, 20 bp, Artificial sequence
  Synthetic Oligonucleotide
caatcataagtttcattcgg

SEQ ID NO: 1178 - DNA, 20 bp, Artificial sequence
  Synthetic Oligonucleotide
tatttcccacaatcataagt

SEQ ID NO: 1179 - DNA, 20 bp, Artificial sequence
  Synthetic Oligonucleotide
cactcccagtatttcccaca

SEQ ID NO: 1180 - DNA, 20 bp, Artificial sequence
  Synthetic Oligonucleotide
taattgctgcaataaggtgg

SEQ ID NO: 1181 - DNA, 20 bp, Artificial sequence
  Synthetic Oligonucleotide
ggttttcattaattgctgca

SEQ ID NO: 1182 - DNA, 20 bp, Artificial sequence
  Synthetic Oligonucleotide
tctgatttcttggttttcat

SEQ ID NO: 1183 - DNA, 20 bp, Artificial sequence
  Synthetic Oligonucleotide
actgtggcactttgcattcc

SEQ ID NO: 1184 - DNA, 20 bp, Artificial sequence
  Synthetic Oligonucleotide
tctatgccaactgtggcact

SEQ ID NO: 1185 - DNA, 20 bp, Artificial sequence
  Synthetic Oligonucleotide
tctttcacatctatgccaac

SEQ ID NO: 1186 - DNA, 20 bp, Artificial sequence
  Synthetic Oligonucleotide
ttttgtctcttatttggata

SEQ ID NO: 1187 - DNA, 20 bp, Artificial sequence
  Synthetic Oligonucleotide
cgagatctctctttcttttg

SEQ ID NO: 1188 - DNA, 20 bp, Artificial sequence
  Synthetic Oligonucleotide
catttaggacgagatctctc

SEQ ID NO: 1189 - DNA, 20 bp, Artificial sequence
  Synthetic Oligonucleotide
acgacctgcaaaatcccaca

SEQ ID NO: 1190 - DNA, 20 bp, Artificial sequence
  Synthetic Oligonucleotide
agtactatagaattcctcac

SEQ ID NO: 1191 - DNA, 20 bp, Artificial sequence
  Synthetic Oligonucleotide
atagacagcaaggtacaatg

SEQ ID NO: 1192 - DNA, 20 bp, Artificial sequence
  Synthetic Oligonucleotide
gctgaggtcatagacagcaa

SEQ ID NO: 1193 - DNA, 20 bp, Artificial sequence
  Synthetic Oligonucleotide
ctgtcccttgctgaggtcat

SEQ ID NO: 1194 - DNA, 20 bp, Artificial sequence
  Synthetic Oligonucleotide
caaggcttcatggcatcaac

SEQ ID NO: 1195 - DNA, 20 bp, Artificial sequence
  Synthetic Oligonucleotide
ttgaagagccaaggcttcat

SEQ ID NO: 1196 - DNA, 20 bp, Artificial sequence
  Synthetic Oligonucleotide
gcctttatattgaagagcca

SEQ ID NO: 1197 - DNA, 20 bp, Artificial sequence
  Synthetic Oligonucleotide
tgccaacgagaatcacaggg

SEQ ID NO: 1198 - DNA, 20 bp, Artificial sequence
  Synthetic Oligonucleotide
ccaaatgtgtgccaacgaga

SEQ ID NO: 1199 - DNA, 20 bp, Artificial sequence
  Synthetic Oligonucleotide
cagaaacatccaaatgtgtg

SEQ ID NO: 1200 - DNA, 20 bp, Artificial sequence
  Synthetic Oligonucleotide
ttactcatgcaggctttgcg

SEQ ID NO: 1201 - DNA, 20 bp, Artificial sequence
  Synthetic Oligonucleotide
ttggtgattttactcatgca

SEQ ID NO: 1202 - DNA, 20 bp, Artificial sequence
  Synthetic Oligonucleotide
ccctcgcttattcaggagtt

SEQ ID NO: 1203 - DNA, 20 bp, Artificial sequence
  Synthetic Oligonucleotide
ggcagggaaccctcgcttat

SEQ ID NO: 1204 - DNA, 20 bp, Artificial sequence
  Synthetic Oligonucleotide
gcatcagattcctcggtggc

SEQ ID NO: 1205 - DNA, 20 bp, Artificial sequence
  Synthetic Oligonucleotide
tttgccaaagcatcagattc

SEQ ID NO: 1206 - DNA, 20 bp, Artificial sequence
  Synthetic Oligonucleotide
tcttgaaattaaggctctcg

SEQ ID NO: 1207 - DNA, 20 bp, Artificial sequence
  Synthetic Oligonucleotide
gatctcggatcttgaaatta

SEQ ID NO: 1208 - DNA, 20 bp, Artificial sequence
  Synthetic Oligonucleotide
cagctgtccaacaacaagct

SEQ ID NO: 1209 - DNA, 20 bp, Artificial sequence
  Synthetic Oligonucleotide
gtctggaatcagctgtccaa

SEQ ID NO: 1210 - DNA, 20 bp, Artificial sequence
  Synthetic Oligonucleotide
tacatagcagtctggaatca

SEQ ID NO: 1211 - DNA, 20 bp, Artificial sequence
  Synthetic Oligonucleotide
tccgataaaatgattttttc

SEQ ID NO: 1212 - DNA, 20 bp, Artificial sequence
  Synthetic Oligonucleotide
tttttacgctccgataaaat

SEQ ID NO: 1213 - DNA, 20 bp, Artificial sequence
  Synthetic Oligonucleotide
attggcacatttttacgctc

SEQ ID NO: 1214 - DNA, 20 bp, Artificial sequence
  Synthetic Oligonucleotide
gtttccggtcaattacggga

SEQ ID NO: 1215 - DNA, 20 bp, Artificial sequence
  Synthetic Oligonucleotide
ctcactagttgtaataatcg

SEQ ID NO: 1216 - DNA, 20 bp, Artificial sequence
  Synthetic Oligonucleotide
ttcatctaactgcagctgat

SEQ ID NO: 1217 - DNA, 20 bp, Artificial sequence
  Synthetic Oligonucleotide
gaagctcattttcatctaac

SEQ ID NO: 1218 - DNA, 20 bp, Artificial sequence
  Synthetic Oligonucleotide
actcctgattcatttagaaa

SEQ ID NO: 1219 - DNA, 20 bp, Artificial sequence
  Synthetic Oligonucleotide
tgaagaaggactcctgattc

SEQ ID NO: 1220 - DNA, 20 bp, Artificial sequence
  Synthetic Oligonucleotide
tcttgaaaatgaagaaggac

SEQ ID NO: 1221 - DNA, 20 bp, Artificial sequence
  Synthetic Oligonucleotide
agtgctgggtcttgaaaatg

SEQ ID NO: 1222 - DNA, 20 bp, Artificial sequence
  Synthetic Oligonucleotide
aagtacaagtcacttaactg

SEQ ID NO: 1223 - DNA, 20 bp, Artificial sequence
  Synthetic Oligonucleotide
tgtcaaaatctgtgccatga

SEQ ID NO: 1224 - DNA, 20 bp, Artificial sequence
  Synthetic Oligonucleotide
cactttcactgtcaaaatct

SEQ ID NO: 1225 - DNA, 20 bp, Artificial sequence
  Synthetic Oligonucleotide
acaaccttccactttcactg

SEQ ID NO: 1226 - DNA, 20 bp, Artificial sequence
  Synthetic Oligonucleotide
gaaataatgcccttagggtg

SEQ ID NO: 1227 - DNA, 20 bp, Artificial sequence
  Synthetic Oligonucleotide
tctctacgcgaaataatgcc

SEQ ID NO: 1228 - DNA, 20 bp, Artificial sequence
  Synthetic Oligonucleotide
ttttccacatctctacgcga

SEQ ID NO: 1229 - DNA, 20 bp, Artificial sequence
  Synthetic Oligonucleotide
gaaagaaatttttccacatc

SEQ ID NO: 1230 - DNA, 20 bp, Artificial sequence
  Synthetic Oligonucleotide
tggaaatttccttttttttg

SEQ ID NO: 1231 - DNA, 20 bp, Artificial sequence
  Synthetic Oligonucleotide
tgtagttctttggaaatttc

SEQ ID NO: 1232 - DNA, 20 bp, Artificial sequence
  Synthetic Oligonucleotide
actgtgacatgtagttcttt

SEQ ID NO: 1233 - DNA, 20 bp, Artificial sequence
  Synthetic Oligonucleotide
tggaatttttctaggagctt

SEQ ID NO: 1234 - DNA, 20 bp, Artificial sequence
  Synthetic Oligonucleotide
caaagcaatctggaattttt

SEQ ID NO: 1235 - DNA, 20 bp, Artificial sequence
  Synthetic Oligonucleotide
tcctattggcaaagcaatct

SEQ ID NO: 1236 - DNA, 20 bp, Artificial sequence
  Synthetic Oligonucleotide
atattcttctcctattggca

SEQ ID NO: 1237 - DNA, 20 bp, Artificial sequence
  Synthetic Oligonucleotide
actgcttggaaccagcaaat

SEQ ID NO: 1238 - DNA, 20 bp, Artificial sequence
  Synthetic Oligonucleotide
gtcagacaaactgcttggaa

SEQ ID NO: 1239 - DNA, 20 bp, Artificial sequence
  Synthetic Oligonucleotide
aggcctgtggtcagacaaac

SEQ ID NO: 1240 - DNA, 20 bp, Artificial sequence
  Synthetic Oligonucleotide
ctctatcacaggcctgtggt

SEQ ID NO: 1241 - DNA, 20 bp, Artificial sequence
  Synthetic Oligonucleotide
gatgataatttcagagttct

SEQ ID NO: 1242 - DNA, 20 bp, Artificial sequence
  Synthetic Oligonucleotide
atatagtcggatgataattt

SEQ ID NO: 1243 - DNA, 20 bp, Artificial sequence
  Synthetic Oligonucleotide
aggcatttcatatagtcgga

SEQ ID NO: 1244 - DNA, 20 bp, Artificial sequence
  Synthetic Oligonucleotide
ttggaaaataaggcatttca

SEQ ID NO: 1245 - DNA, 20 bp, Artificial sequence
  Synthetic Oligonucleotide
ttaatcttgaccaaaatccc

SEQ ID NO: 1246 - DNA, 20 bp, Artificial sequence
  Synthetic Oligonucleotide
atcgattgattaatcttgac

SEQ ID NO: 1247 - DNA, 20 bp, Artificial sequence
  Synthetic Oligonucleotide
tctcaagtaatcgattgatt

SEQ ID NO: 1248 - DNA, 20 bp, Artificial sequence
  Synthetic Oligonucleotide
ctccctgaaagcatgtaagg

SEQ ID NO: 1249 - DNA, 20 bp, Artificial sequence
  Synthetic Oligonucleotide
ctgtttgggcgaagtgctcg

SEQ ID NO: 1250 - DNA, 20 bp, Artificial sequence
  Synthetic Oligonucleotide
tacattctgtttgggcgaag

SEQ ID NO: 1251 - DNA, 20 bp, Artificial sequence
  Synthetic Oligonucleotide
atacattctgtttgggcgaa

SEQ ID NO: 1252 - DNA, 20 bp, Artificial sequence
  Synthetic Oligonucleotide
aatacattctgtttgggcga

SEQ ID NO: 1253 - DNA, 20 bp, Artificial sequence
  Synthetic Oligonucleotide
caatacattctgtttgggcg

SEQ ID NO: 1254 - DNA, 20 bp, Artificial sequence
  Synthetic Oligonucleotide
ccaatacattctgtttgggc

SEQ ID NO: 1255 - DNA, 20 bp, Artificial sequence
  Synthetic Oligonucleotide
cgccaatacattctgtttgg

SEQ ID NO: 1256 - DNA, 20 bp, Artificial sequence
  Synthetic Oligonucleotide
tcgccaatacattctgtttg

SEQ ID NO: 1257 - DNA, 20 bp, Artificial sequence
  Synthetic Oligonucleotide
gtcgccaatacattctgttt

SEQ ID NO: 1258 - DNA, 20 bp, Artificial sequence
  Synthetic Oligonucleotide
tgtcgccaatacattctgtt

SEQ ID NO: 1259 - DNA, 20 bp, Artificial sequence
  Synthetic Oligonucleotide
ttgtcgccaatacattctgt

SEQ ID NO: 1260 - DNA, 20 bp, Artificial sequence
  Synthetic Oligonucleotide
tgccttgtcgccaatacatt

SEQ ID NO: 1261 - DNA, 20 bp, Artificial sequence
  Synthetic Oligonucleotide
ttaagtaaatgccttgtcgc

SEQ ID NO: 1262 - DNA, 20 bp, Artificial sequence
  Synthetic Oligonucleotide
gagaccaatttaagtaaatg

SEQ ID NO: 1263 - DNA, 20 bp, Artificial sequence
  Synthetic Oligonucleotide
agatcctaccagacaataag

SEQ ID NO: 1264 - DNA, 20 bp, Artificial sequence
  Synthetic Oligonucleotide
taagacttcagatcctacca

SEQ ID NO: 1265 - DNA, 20 bp, Artificial sequence
  Synthetic Oligonucleotide
atgattgtctaagacttcag

SEQ ID NO: 1266 - DNA, 20 bp, Artificial sequence
  Synthetic Oligonucleotide
actctctggatgattgtcta

SEQ ID NO: 1267 - DNA, 20 bp, Artificial sequence
  Synthetic Oligonucleotide
ggaactgtaatttttaagaa

SEQ ID NO: 1268 - DNA, 20 bp, Artificial sequence
  Synthetic Oligonucleotide
ctacaagaaggaactgtaat

SEQ ID NO: 1269 - DNA, 20 bp, Artificial sequence
  Synthetic Oligonucleotide
cagccttttctacaagaagg

SEQ ID NO: 1270 - DNA, 20 bp, Artificial sequence
  Synthetic Oligonucleotide
ggtccacaacttggcccaaa

SEQ ID NO: 1271 - DNA, 20 bp, Artificial sequence
  Synthetic Oligonucleotide
aatcaatgtggtccacaact

SEQ ID NO: 1272 - DNA, 20 bp, Artificial sequence
  Synthetic Oligonucleotide
ccatgagagaatcaatgtgg

SEQ ID NO: 1273 - DNA, 20 bp, Artificial sequence
  Synthetic Oligonucleotide
accattcttccatgagagaa

SEQ ID NO: 1274 - DNA, 20 bp, Artificial sequence
  Synthetic Oligonucleotide
caatctccagcaacccagga

SEQ ID NO: 1275 - DNA, 20 bp, Artificial sequence
  Synthetic Oligonucleotide
ccacaaatatcaatctccag

SEQ ID NO: 1276 - DNA, 20 bp, Artificial sequence
  Synthetic Oligonucleotide
tctccttcaccacaaatatc

SEQ ID NO: 1277 - DNA, 20 bp, Artificial sequence
  Synthetic Oligonucleotide
atttcttcaacagagtttct

SEQ ID NO: 1278 - DNA, 20 bp, Artificial sequence
  Synthetic Oligonucleotide
catttcttcaacagagtttc

SEQ ID NO: 1279 - DNA, 20 bp, Artificial sequence
  Synthetic Oligonucleotide
cccatttcttcaacagagtt

SEQ ID NO: 1280 - DNA, 20 bp, Artificial sequence
  Synthetic Oligonucleotide
tgcccatttcttcaacagag

SEQ ID NO: 1281 - DNA, 20 bp, Artificial sequence
  Synthetic Oligonucleotide
aatgcccatttcttcaacag

SEQ ID NO: 1282 - DNA, 20 bp, Artificial sequence
  Synthetic Oligonucleotide
taatgcccatttcttcaaca

SEQ ID NO: 1283 - DNA, 20 bp, Artificial sequence
  Synthetic Oligonucleotide
taaaactatataatgcccat

SEQ ID NO: 1284 - DNA, 20 bp, Artificial sequence
  Synthetic Oligonucleotide
caccatcattaaaactatat

SEQ ID NO: 1285 - DNA, 20 bp, Artificial sequence
  Synthetic Oligonucleotide
atcaagtaagattttttgat

SEQ ID NO: 1286 - DNA, 20 bp, Artificial sequence
  Synthetic Oligonucleotide
catcaagtcatcaagtaaga

SEQ ID NO: 1287 - DNA, 20 bp, Artificial sequence
  Synthetic Oligonucleotide
tgctttcttcatcaagtcat

SEQ ID NO: 1288 - DNA, 20 bp, Artificial sequence
  Synthetic Oligonucleotide
tggatttactaagagatctc

SEQ ID NO: 1289 - DNA, 20 bp, Artificial sequence
  Synthetic Oligonucleotide
tggttgatctggatttacta

SEQ ID NO: 1290 - DNA, 20 bp, Artificial sequence
  Synthetic Oligonucleotide
ggtgagccttggttgatctg

SEQ ID NO: 1291 - DNA, 20 bp, Artificial sequence
  Synthetic Oligonucleotide
cagccaaaatcaagtcaggg

SEQ ID NO: 1292 - DNA, 20 bp, Artificial sequence
  Synthetic Oligonucleotide
taggcaggtcagccaaaatc

SEQ ID NO: 1293 - DNA, 20 bp, Artificial sequence
  Synthetic Oligonucleotide
atcattattcaacataatat

SEQ ID NO: 1294 - DNA, 20 bp, Artificial sequence
  Synthetic Oligonucleotide
ttccaactcatcattattca

SEQ ID NO: 1295 - DNA, 20 bp, Artificial sequence
  Synthetic Oligonucleotide
ttgttcaaattccaactcat

SEQ ID NO: 1296 - DNA, 20 bp, Artificial sequence
  Synthetic Oligonucleotide
atcacctaggagaaactctg

SEQ ID NO: 1297 - DNA, 20 bp, Artificial sequence
  Synthetic Oligonucleotide
aaaactgccatcacctagga

SEQ ID NO: 1298 - DNA, 20 bp, Artificial sequence
  Synthetic Oligonucleotide
aactgatccaaaactgccat

SEQ ID NO: 1299 - DNA, 20 bp, Artificial sequence
  Synthetic Oligonucleotide
tcttctccttcataggctgc

SEQ ID NO: 1300 - DNA, 20 bp, Artificial sequence
  Synthetic Oligonucleotide
acagccacttcttctccttc

SEQ ID NO: 1301 - DNA, 20 bp, Artificial sequence
  Synthetic Oligonucleotide
acagcctgagtgatgtatgt

SEQ ID NO: 1302 - DNA, 20 bp, Artificial sequence
  Synthetic Oligonucleotide
cttgtcttaacagcctgagt

SEQ ID NO: 1303 - DNA, 20 bp, Artificial sequence
  Synthetic Oligonucleotide
ccacaagctcttgtcttaac

SEQ ID NO: 1304 - DNA, 20 bp, Artificial sequence
  Synthetic Oligonucleotide
agcaaagatatcaaactggg

SEQ ID NO: 1305 - DNA, 20 bp, Artificial sequence
  Synthetic Oligonucleotide
ccagctgccagcaaagatat

SEQ ID NO: 1306 - DNA, 20 bp, Artificial sequence
  Synthetic Oligonucleotide
ggacgaatcccagctgccag

SEQ ID NO: 1307 - DNA, 20 bp, Artificial sequence
  Synthetic Oligonucleotide
ggaggctaactccatcacca

SEQ ID NO: 1308 - DNA, 20 bp, Artificial sequence
  Synthetic Oligonucleotide
ggaacccttggaggctaact

SEQ ID NO: 1309 - DNA, 20 bp, Artificial sequence
  Synthetic Oligonucleotide
gcgatccaaggaacccttgg

SEQ ID NO: 1310 - DNA, 20 bp, Artificial sequence
  Synthetic Oligonucleotide
aggctggctttgtcctgctg

SEQ ID NO: 1311 - DNA, 20 bp, Artificial sequence
  Synthetic Oligonucleotide
gttctagtgaggctggcttt

SEQ ID NO: 1312 - DNA, 20 bp, Artificial sequence
  Synthetic Oligonucleotide
tgctgtagggttctagtgag

SEQ ID NO: 1313 - DNA, 20 bp, Artificial sequence
  Synthetic Oligonucleotide
atctcaaaccatcagctacg

SEQ ID NO: 1314 - DNA, 20 bp, Artificial sequence
  Synthetic Oligonucleotide
agtggaggtatctcaaacca

SEQ ID NO: 1315 - DNA, 20 bp, Artificial sequence
  Synthetic Oligonucleotide
caggtctcggtatataatca

SEQ ID NO: 1316 - DNA, 20 bp, Artificial sequence
  Synthetic Oligonucleotide
gaaaagcagcacattgtggg

SEQ ID NO: 1317 - DNA, 20 bp, Artificial sequence
  Synthetic Oligonucleotide
gcagcattgggatacagtgt

SEQ ID NO: 1318 - DNA, 20 bp, Artificial sequence
  Synthetic Oligonucleotide
gcaatgatggcagcattggg

SEQ ID NO: 1319 - DNA, 20 bp, Artificial sequence
  Synthetic Oligonucleotide
tatccccattctacagcagt

SEQ ID NO: 1320 - DNA, 20 bp, Artificial sequence
  Synthetic Oligonucleotide
tgatgtttttatccccattc

SEQ ID NO: 1321 - DNA, 20 bp, Artificial sequence
  Synthetic Oligonucleotide
cacgaaaccctggtgtgccc

SEQ ID NO: 1322 - DNA, 20 bp, Artificial sequence
  Synthetic Oligonucleotide
cttcaggtgcacgaaaccct

SEQ ID NO: 1323 - DNA, 20 bp, Artificial sequence
  Synthetic Oligonucleotide
ctctggcaacttcaggtgca

SEQ ID NO: 1324 - DNA, 20 bp, Artificial sequence
  Synthetic Oligonucleotide
agcctgttggttataaatga

SEQ ID NO: 1325 - DNA, 20 bp, Artificial sequence
  Synthetic Oligonucleotide
ataaacatcagcctgttggt

SEQ ID NO: 1326 - DNA, 20 bp, Artificial sequence
  Synthetic Oligonucleotide
accaaatgaataaacatcag

SEQ ID NO: 1327 - DNA, 20 bp, Artificial sequence
  Synthetic Oligonucleotide
gttgtcaaaatgtcatagag

SEQ ID NO: 1328 - DNA, 20 bp, Artificial sequence
  Synthetic Oligonucleotide
ctacctccagttgtcaaaat

SEQ ID NO: 1329 - DNA, 20 bp, Artificial sequence
  Synthetic Oligonucleotide
tctactattctacctccagt

SEQ ID NO: 1330 - DNA, 20 bp, Artificial sequence
  Synthetic Oligonucleotide
ttcaaaccctctactattct

SEQ ID NO: 1331 - DNA, 20 bp, Artificial sequence
  Synthetic Oligonucleotide
atcaaactcatttggaaact

SEQ ID NO: 1332 - DNA, 20 bp, Artificial sequence
  Synthetic Oligonucleotide
ttctaattcatcaaactcat

SEQ ID NO: 1333 - DNA, 20 bp, Artificial sequence
  Synthetic Oligonucleotide
tccttgtatttctaattcat

SEQ ID NO: 1334 - DNA, 20 bp, Artificial sequence
  Synthetic Oligonucleotide
tattctttaactggatcagg

SEQ ID NO: 1335 - DNA, 20 bp, Artificial sequence
  Synthetic Oligonucleotide
gcacaaccatattctttaac

SEQ ID NO: 1336 - DNA, 20 bp, Artificial sequence
  Synthetic Oligonucleotide
actgtttaattaatttctca

SEQ ID NO: 1337 - DNA, 20 bp, Artificial sequence
  Synthetic Oligonucleotide
ctttcaaacactgtttaatt

SEQ ID NO: 1338 - DNA, 20 bp, Artificial sequence
  Synthetic Oligonucleotide
gaggattttctttcaaacac

SEQ ID NO: 1339 - DNA, 20 bp, Artificial sequence
  Synthetic Oligonucleotide
gacctgggcagaagtaggcc

SEQ ID NO: 1340 - DNA, 20 bp, Artificial sequence
  Synthetic Oligonucleotide
aatgtcaaagacctgggcag

SEQ ID NO: 1341 - DNA, 20 bp, Artificial sequence
  Synthetic Oligonucleotide
tgaattcaaaatgtcaaaga

SEQ ID NO: 1342 - DNA, 20 bp, Artificial sequence
  Synthetic Oligonucleotide
tttttaggtaataaaatgcg

SEQ ID NO: 1343 - DNA, 20 bp, Artificial sequence
  Synthetic Oligonucleotide
gtgtagcaaccatgcattca

SEQ ID NO: 1344 - DNA, 20 bp, Artificial sequence
  Synthetic Oligonucleotide
cattcctgctgttgtgatgt

SEQ ID NO: 1345 - DNA, 20 bp, Artificial sequence
  Synthetic Oligonucleotide
gccaaatgcttgcattcctg

SEQ ID NO: 1346 - DNA, 20 bp, Artificial sequence
  Synthetic Oligonucleotide
agccaaatgcttgcattcct

SEQ ID NO: 1347 - DNA, 20 bp, Artificial sequence
  Synthetic Oligonucleotide
cagccaaatgcttgcattcc

SEQ ID NO: 1348 - DNA, 20 bp, Artificial sequence
  Synthetic Oligonucleotide
ccagccaaatgcttgcattc

SEQ ID NO: 1349 - DNA, 20 bp, Artificial sequence
  Synthetic Oligonucleotide
cccagccaaatgcttgcatt

SEQ ID NO: 1350 - DNA, 20 bp, Artificial sequence
  Synthetic Oligonucleotide
cagcccagccaaatgcttgc

SEQ ID NO: 1351 - DNA, 20 bp, Artificial sequence
  Synthetic Oligonucleotide
acagcccagccaaatgcttg

SEQ ID NO: 1352 - DNA, 20 bp, Artificial sequence
  Synthetic Oligonucleotide
cacagcccagccaaatgctt

SEQ ID NO: 1353 - DNA, 20 bp, Artificial sequence
  Synthetic Oligonucleotide
ccacagcccagccaaatgct

SEQ ID NO: 1354 - DNA, 20 bp, Artificial sequence
  Synthetic Oligonucleotide
gtgcccacagcccagccaaa

SEQ ID NO: 1355 - DNA, 20 bp, Artificial sequence
  Synthetic Oligonucleotide
tctgtcggtgtgcccacagc

SEQ ID NO: 1356 - DNA, 20 bp, Artificial sequence
  Synthetic Oligonucleotide
gagctgtcctctgtcggtgt

SEQ ID NO: 1357 - DNA, 20 bp, Artificial sequence
  Synthetic Oligonucleotide
ccttcagtatttaagtcaag

SEQ ID NO: 1358 - DNA, 20 bp, Artificial sequence
  Synthetic Oligonucleotide
gaagtgtatccttcagtatt

SEQ ID NO: 1359 - DNA, 20 bp, Artificial sequence
  Synthetic Oligonucleotide
acttcctcagaagtgtatcc

SEQ ID NO: 1360 - DNA, 20 bp, Artificial sequence
  Synthetic Oligonucleotide
ctaagcacaatattctacta

SEQ ID NO: 1361 - DNA, 20 bp, Artificial sequence
  Synthetic Oligonucleotide
gcaccaaggctaagcacaat

SEQ ID NO: 1362 - DNA, 20 bp, Artificial sequence
  Synthetic Oligonucleotide
caggaagatgcaccaaggct

SEQ ID NO: 1363 - DNA, 20 bp, Artificial sequence
  Synthetic Oligonucleotide
agacacaatccagctttcct

SEQ ID NO: 1364 - DNA, 20 bp, Artificial sequence
  Synthetic Oligonucleotide
ctgtgtcccagacacaatcc

SEQ ID NO: 1365 - DNA, 20 bp, Artificial sequence
  Synthetic Oligonucleotide
agtaccagactgtgtcccag

SEQ ID NO: 1366 - DNA, 20 bp, Artificial sequence
  Synthetic Oligonucleotide
ccatcttcggtattgatgac

SEQ ID NO: 1367 - DNA, 20 bp, Artificial sequence
  Synthetic Oligonucleotide
ctctttttcccatcttcggt

SEQ ID NO: 1368 - DNA, 20 bp, Artificial sequence
  Synthetic Oligonucleotide
agggtatgtctctttttccc

SEQ ID NO: 1369 - DNA, 20 bp, Artificial sequence
  Synthetic Oligonucleotide
aatacaaacaagtgacagaa

SEQ ID NO: 1370 - DNA, 20 bp, Artificial sequence
  Synthetic Oligonucleotide
ggaaaaggaattgcaataca

SEQ ID NO: 1371 - DNA, 20 bp, Artificial sequence
  Synthetic Oligonucleotide
gttccaaccaaaagaaaatt

SEQ ID NO: 1372 - DNA, 20 bp, Artificial sequence
  Synthetic Oligonucleotide
ccatcagcggttccaaccaa

SEQ ID NO: 1373 - DNA, 20 bp, Artificial sequence
  Synthetic Oligonucleotide
tcaaaaattgctaacttgcc

SEQ ID NO: 1374 - DNA, 20 bp, Artificial sequence
  Synthetic Oligonucleotide
gtcttatcttcaaaaattgc

SEQ ID NO: 1375 - DNA, 20 bp, Artificial sequence
  Synthetic Oligonucleotide
agcttaacagtcttatcttc

SEQ ID NO: 1376 - DNA, 20 bp, Artificial sequence
  Synthetic Oligonucleotide
gtatcttcaaaggagcagct

SEQ ID NO: 1377 - DNA, 20 bp, Artificial sequence
  Synthetic Oligonucleotide
cctatatttagtatcttcaa

SEQ ID NO: 1378 - DNA, 20 bp, Artificial sequence
  Synthetic Oligonucleotide
ctgacatttcctatatttag

SEQ ID NO: 1379 - DNA, 20 bp, Artificial sequence
  Synthetic Oligonucleotide
ttcactcaaacacatcaatg

SEQ ID NO: 1380 - DNA, 20 bp, Artificial sequence
  Synthetic Oligonucleotide
atttgtggattcactcaaac

SEQ ID NO: 1381 - DNA, 20 bp, Artificial sequence
  Synthetic Oligonucleotide
ttccgttgaatttgtggatt

SEQ ID NO: 1382 - DNA, 20 bp, Artificial sequence
  Synthetic Oligonucleotide
ccacatcctccccacattac

SEQ ID NO: 1383 - DNA, 20 bp, Artificial sequence
  Synthetic Oligonucleotide
atctttgtgccacatcctcc

SEQ ID NO: 1384 - DNA, 20 bp, Artificial sequence
  Synthetic Oligonucleotide
cattagaaaaggagaaaatc

SEQ ID NO: 1385 - DNA, 20 bp, Artificial sequence
  Synthetic Oligonucleotide
gtttctgaatggtgaaatca

SEQ ID NO: 1386 - DNA, 20 bp, Artificial sequence
  Synthetic Oligonucleotide
tctcaatgagtttctgaatg

SEQ ID NO: 1387 - DNA, 20 bp, Artificial sequence
  Synthetic Oligonucleotide
ttgttcttgtctcaatgagt

SEQ ID NO: 1388 - DNA, 20 bp, Artificial sequence
  Synthetic Oligonucleotide
acagttggcttgttcttgtc

SEQ ID NO: 1389 - DNA, 20 bp, Artificial sequence
  Synthetic Oligonucleotide
tgaaagctgcataagaaaac

SEQ ID NO: 1390 - DNA, 20 bp, Artificial sequence
  Synthetic Oligonucleotide
tggaatcactgaaagctgca

SEQ ID NO: 1391 - DNA, 20 bp, Artificial sequence
  Synthetic Oligonucleotide
ttatgatgttggaatcactg

SEQ ID NO: 1392 - DNA, 20 bp, Artificial sequence
  Synthetic Oligonucleotide
atagagagcagtgtctacca

SEQ ID NO: 1393 - DNA, 20 bp, Artificial sequence
  Synthetic Oligonucleotide
cttagcaatatagagagcag

SEQ ID NO: 1394 - DNA, 20 bp, Artificial sequence
  Synthetic Oligonucleotide
gctattttgcttagcaatat

SEQ ID NO: 1395 - DNA, 20 bp, Artificial sequence
  Synthetic Oligonucleotide
ttcttatcccacacttccac

SEQ ID NO: 1396 - DNA, 20 bp, Artificial sequence
  Synthetic Oligonucleotide
tttttcagttttcttatccc

SEQ ID NO: 1397 - DNA, 20 bp, Artificial sequence
  Synthetic Oligonucleotide
tccacagagtttttcagttt

SEQ ID NO: 1398 - DNA, 20 bp, Artificial sequence
  Synthetic Oligonucleotide
ttaaaaagtgcacgcagtct

SEQ ID NO: 1399 - DNA, 20 bp, Artificial sequence
  Synthetic Oligonucleotide
ttacctcccttaaaaagtgc

SEQ ID NO: 1400 - DNA, 20 bp, Artificial sequence
  Synthetic Oligonucleotide
cttttaccattacctccctt

SEQ ID NO: 1401 - DNA, 20 bp, Artificial sequence
  Synthetic Oligonucleotide
ccttgttttcttttaccatt

SEQ ID NO: 1402 - DNA, 20 bp, Artificial sequence
  Synthetic Oligonucleotide
tcccagaataagacattttg

SEQ ID NO: 1403 - DNA, 20 bp, Artificial sequence
  Synthetic Oligonucleotide
ttttcactctcccagaataa

SEQ ID NO: 1404 - DNA, 20 bp, Artificial sequence
  Synthetic Oligonucleotide
agtgttcttctgaaggcaga

SEQ ID NO: 1405 - DNA, 20 bp, Artificial sequence
  Synthetic Oligonucleotide
ccaaagagcagtgttcttct

SEQ ID NO: 1406 - DNA, 20 bp, Artificial sequence
  Synthetic Oligonucleotide
agttcctatccaaagagcag

SEQ ID NO: 1407 - DNA, 20 bp, Artificial sequence
  Synthetic Oligonucleotide
tccaggagtaaaatatggcc

SEQ ID NO: 1408 - DNA, 20 bp, Artificial sequence
  Synthetic Oligonucleotide
gttgaaagatccaggagtaa

SEQ ID NO: 1409 - DNA, 20 bp, Artificial sequence
  Synthetic Oligonucleotide
agtcgacgagttgaaagatc

SEQ ID NO: 1410 - DNA, 20 bp, Artificial sequence
  Synthetic Oligonucleotide
accgaattacaaaagttgta

SEQ ID NO: 1411 - DNA, 20 bp, Artificial sequence
  Synthetic Oligonucleotide
atgactctgaccgaattaca

SEQ ID NO: 1412 - DNA, 20 bp, Artificial sequence
  Synthetic Oligonucleotide
gctgtcatcatgactctgac

SEQ ID NO: 1413 - DNA, 20 bp, Artificial sequence
  Synthetic Oligonucleotide
tgacatttttaaggcttcct

SEQ ID NO: 1414 - DNA, 20 bp, Artificial sequence
  Synthetic Oligonucleotide
ccaataccagcatgacattt

SEQ ID NO: 1415 - DNA, 20 bp, Artificial sequence
  Synthetic Oligonucleotide
ggttgtagcccaataccagc

SEQ ID NO: 1416 - DNA, 20 bp, Artificial sequence
  Synthetic Oligonucleotide
ttgtgtaccttcagtatttt

SEQ ID NO: 1417 - DNA, 20 bp, Artificial sequence
  Synthetic Oligonucleotide
ctttctgcttttgtgtacct

SEQ ID NO: 1418 - DNA, 20 bp, Artificial sequence
  Synthetic Oligonucleotide
attgtatctctttctgcttt

SEQ ID NO: 1419 - DNA, 20 bp, Artificial sequence
  Synthetic Oligonucleotide
ttgatgtcccaaacggtcaa

SEQ ID NO: 1420 - DNA, 20 bp, Artificial sequence
  Synthetic Oligonucleotide
tgtggaagattgatgtccca

SEQ ID NO: 1421 - DNA, 20 bp, Artificial sequence
  Synthetic Oligonucleotide
tgcacttcatgtggaagatt

SEQ ID NO: 1422 - DNA, 20 bp, Artificial sequence
  Synthetic Oligonucleotide
tctaaattttgcacttcatg

SEQ ID NO: 1423 - DNA, 20 bp, Artificial sequence
  Synthetic Oligonucleotide
ttctcacttcaatgtgtttt

SEQ ID NO: 1424 - DNA, 20 bp, Artificial sequence
  Synthetic Oligonucleotide
ctaattcttttctcacttca

SEQ ID NO: 1425 - DNA, 20 bp, Artificial sequence
  Synthetic Oligonucleotide
tcattttttcagctaattct

SEQ ID NO: 1426 - DNA, 20 bp, Artificial sequence
  Synthetic Oligonucleotide
ctatttctctcttactcaac

SEQ ID NO: 1427 - DNA, 20 bp, Artificial sequence
  Synthetic Oligonucleotide
agacaattcctatttctctc

SEQ ID NO: 1428 - DNA, 20 bp, Artificial sequence
  Synthetic Oligonucleotide
ttcctatccaaagacaattc

SEQ ID NO: 1429 - DNA, 20 bp, Artificial sequence
  Synthetic Oligonucleotide
tatttacaagaggagagaat

SEQ ID NO: 1430 - DNA, 20 bp, Artificial sequence
  Synthetic Oligonucleotide
ccctttccatgtgaacattt

SEQ ID NO: 1431 - DNA, 20 bp, Artificial sequence
  Synthetic Oligonucleotide
accctttccatgtgaacatt

SEQ ID NO: 1432 - DNA, 20 bp, Artificial sequence
  Synthetic Oligonucleotide
taccctttccatgtgaacat

SEQ ID NO: 1433 - DNA, 20 bp, Artificial sequence
  Synthetic Oligonucleotide
gtaccctttccatgtgaaca

SEQ ID NO: 1434 - DNA, 20 bp, Artificial sequence
  Synthetic Oligonucleotide
agtaccctttccatgtgaac

SEQ ID NO: 1435 - DNA, 20 bp, Artificial sequence
  Synthetic Oligonucleotide
tgagtaccctttccatgtga

SEQ ID NO: 1436 - DNA, 20 bp, Artificial sequence
  Synthetic Oligonucleotide
gtgagtaccctttccatgtg

SEQ ID NO: 1437 - DNA, 20 bp, Artificial sequence
  Synthetic Oligonucleotide
tgtgagtaccctttccatgt

SEQ ID NO: 1438 - DNA, 20 bp, Artificial sequence
  Synthetic Oligonucleotide
atgtgagtaccctttccatg

SEQ ID NO: 1439 - DNA, 20 bp, Artificial sequence
  Synthetic Oligonucleotide
aatgtgagtaccctttccat

SEQ ID NO: 1440 - DNA, 20 bp, Artificial sequence
  Synthetic Oligonucleotide
aaaaaatgtgagtacccttt

SEQ ID NO: 1441 - DNA, 20 bp, Artificial sequence
  Synthetic Oligonucleotide
agctatttcaaaaaatgtga

SEQ ID NO: 1442 - DNA, 20 bp, Artificial sequence
  Synthetic Oligonucleotide
atacacacgagctatttcaa

SEQ ID NO: 1443 - DNA, 20 bp, Artificial sequence
  Synthetic Oligonucleotide
cattccttcatacacacgag

SEQ ID NO: 1444 - DNA, 20 bp, Artificial sequence
  Synthetic Oligonucleotide
gtaagtatttttacatatat

SEQ ID NO: 1445 - DNA, 20 bp, Artificial sequence
  Synthetic Oligonucleotide
tagttctttaaaatacacat

SEQ ID NO: 1446 - DNA, 20 bp, Artificial sequence
  Synthetic Oligonucleotide
ttgtgttttaaatagttctt

SEQ ID NO: 1447 - DNA, 20 bp, Artificial sequence
  Synthetic Oligonucleotide
aatataacattgtgttttaa

SEQ ID NO: 1448 - DNA, 20 bp, Artificial sequence
  Synthetic Oligonucleotide
cgaaagtaactggtatttat

SEQ ID NO: 1449 - DNA, 20 bp, Artificial sequence
  Synthetic Oligonucleotide
attaatgaacgaaagtaact

SEQ ID NO: 1450 - DNA, 20 bp, Artificial sequence
  Synthetic Oligonucleotide
ttttcattaattaatgaacg

SEQ ID NO: 1451 - DNA, 20 bp, Artificial sequence
  Synthetic Oligonucleotide
acagatttattttcattaat

SEQ ID NO: 1452 - DNA, 20 bp, Artificial sequence
  Synthetic Oligonucleotide
agtacttaaattaggtactt

SEQ ID NO: 1453 - DNA, 20 bp, Artificial sequence
  Synthetic Oligonucleotide
tttagtatgagtacttaaat

SEQ ID NO: 1454 - DNA, 20 bp, Artificial sequence
  Synthetic Oligonucleotide
cttataaattttagtatgag

SEQ ID NO: 1455 - DNA, 20 bp, Artificial sequence
  Synthetic Oligonucleotide
cattacagacaagaaaacaa

SEQ ID NO: 1456 - DNA, 20 bp, Artificial sequence
  Synthetic Oligonucleotide
gtttacctccattacagaca

SEQ ID NO: 1457 - DNA, 20 bp, Artificial sequence
  Synthetic Oligonucleotide
taaaataaagtttacctcca

SEQ ID NO: 1458 - DNA, 20 bp, Artificial sequence
  Synthetic Oligonucleotide
tagtcctgtcttaagcacag

SEQ ID NO: 1459 - DNA, 20 bp, Artificial sequence
  Synthetic Oligonucleotide
gacaagcaatagtcctgtct

SEQ ID NO: 1460 - DNA, 20 bp, Artificial sequence
  Synthetic Oligonucleotide
agaaaaatcgacaagcaata

SEQ ID NO: 1461 - DNA, 20 bp, Artificial sequence
  Synthetic Oligonucleotide
attttcattataccgtgcag

SEQ ID NO: 1462 - DNA, 20 bp, Artificial sequence
  Synthetic Oligonucleotide
actgtcttaatattttcatt

SEQ ID NO: 1463 - DNA, 20 bp, Artificial sequence
  Synthetic Oligonucleotide
acatgggaaactgtcttaat

SEQ ID NO: 1464 - DNA, 20 bp, Artificial sequence
  Synthetic Oligonucleotide
atgcaatctaagaaggaata

SEQ ID NO: 1465 - DNA, 20 bp, Artificial sequence
  Synthetic Oligonucleotide
tgcatttcgatgcaatctaa

SEQ ID NO: 1466 - DNA, 20 bp, Artificial sequence
  Synthetic Oligonucleotide
atatgatagtgcatttcgat

SEQ ID NO: 1467 - DNA, 20 bp, Artificial sequence
  Synthetic Oligonucleotide
tacaagcatatatgatagtg

SEQ ID NO: 1468 - DNA, 20 bp, Artificial sequence
  Synthetic Oligonucleotide
gactttattagtgcaaattc

SEQ ID NO: 1469 - DNA, 20 bp, Artificial sequence
  Synthetic Oligonucleotide
ggactttattagtgcaaatt

SEQ ID NO: 1470 - DNA, 20 bp, Artificial sequence
  Synthetic Oligonucleotide
aggactttattagtgcaaat

SEQ ID NO: 1471 - DNA, 20 bp, Artificial sequence
  Synthetic Oligonucleotide
aaggactttattagtgcaaa

SEQ ID NO: 1472 - DNA, 20 bp, Artificial sequence
  Synthetic Oligonucleotide
caaaggactttattagtgca

SEQ ID NO: 1473 - DNA, 20 bp, Artificial sequence
  Synthetic Oligonucleotide
acaaaggactttattagtgc

SEQ ID NO: 1474 - DNA, 20 bp, Artificial sequence
  Synthetic Oligonucleotide
aacaaaggactttattagtg

SEQ ID NO: 1475 - DNA, 20 bp, Artificial sequence
  Synthetic Oligonucleotide
caacaaaggactttattagt

SEQ ID NO: 1476 - DNA, 20 bp, Artificial sequence
  Synthetic Oligonucleotide
acagcaacaaagagaattca

SEQ ID NO: 1477 - DNA, 20 bp, Artificial sequence
  Synthetic Oligonucleotide
gcactgtttgcaacagcaac

SEQ ID NO: 1478 - DNA, 20 bp, Artificial sequence
  Synthetic Oligonucleotide
gtgtaagatgcactgtttgc

SEQ ID NO: 1479 - DNA, 20 bp, Artificial sequence
  Synthetic Oligonucleotide
tttcttttgaattgagtgaa

SEQ ID NO: 1480 - DNA, 20 bp, Artificial sequence
  Synthetic Oligonucleotide
taatggagttttcttttgaa

SEQ ID NO: 1481 - DNA, 20 bp, Artificial sequence
  Synthetic Oligonucleotide
tagtacttttaatggagttt

SEQ ID NO: 1482 - DNA, 20 bp, Artificial sequence
  Synthetic Oligonucleotide
tttgacagtatgtcatgttt

SEQ ID NO: 1483 - DNA, 20 bp, Artificial sequence
  Synthetic Oligonucleotide
tatgaggactttgacagtat

SEQ ID NO: 1484 - DNA, 20 bp, Artificial sequence
  Synthetic Oligonucleotide
tttcctagatatgaggactt

SEQ ID NO: 1485 - DNA, 20 bp, Artificial sequence
  Synthetic Oligonucleotide
ttctgtgtctttcctagata

SEQ ID NO: 1486 - DNA, 20 bp, Artificial sequence
  Synthetic Oligonucleotide
ttctgtgacaaagagagttt

SEQ ID NO: 1487 - DNA, 20 bp, Artificial sequence
  Synthetic Oligonucleotide
acagagagtttctgtgacaa

SEQ ID NO: 1488 - DNA, 20 bp, Artificial sequence
  Synthetic Oligonucleotide
aggaaagacacagagagttt

SEQ ID NO: 1489 - DNA, 20 bp, Artificial sequence
  Synthetic Oligonucleotide
gagttgaaaaacaactctat

SEQ ID NO: 1490 - DNA, 20 bp, Artificial sequence
  Synthetic Oligonucleotide
tcaaacatagagttgaaaaa

SEQ ID NO: 1491 - DNA, 20 bp, Artificial sequence
  Synthetic Oligonucleotide
tatccacattcaaacataga

SEQ ID NO: 1492 - DNA, 20 bp, Artificial sequence
  Synthetic Oligonucleotide
tacactaattatacaaaatt

SEQ ID NO: 1493 - DNA, 20 bp, Artificial sequence
  Synthetic Oligonucleotide
cactgtatttacactaatta

SEQ ID NO: 1494 - DNA, 20 bp, Artificial sequence
  Synthetic Oligonucleotide
aggactgaacactgtattta

SEQ ID NO: 1495 - DNA, 20 bp, Artificial sequence
  Synthetic Oligonucleotide
atcacttgaaggactgaaca

SEQ ID NO: 1496 - DNA, 20 bp, Artificial sequence
  Synthetic Oligonucleotide
acaagtagctagtggtatga

SEQ ID NO: 1497 - DNA, 20 bp, Artificial sequence
  Synthetic Oligonucleotide
gattagaaaacaagtagcta

SEQ ID NO: 1498 - DNA, 20 bp, Artificial sequence
  Synthetic Oligonucleotide
tagaatgaagcagattagaa

SEQ ID NO: 1499 - DNA, 20 bp, Artificial sequence
  Synthetic Oligonucleotide
ttagggaaaagatgaatata

SEQ ID NO: 1500 - DNA, 20 bp, Artificial sequence
  Synthetic Oligonucleotide
atcacaaatttagggaaaag

SEQ ID NO: 1501 - DNA, 20 bp, Artificial sequence
  Synthetic Oligonucleotide
atctgcagcatcacaaattt

SEQ ID NO: 1502 - DNA, 20 bp, Artificial sequence
  Synthetic Oligonucleotide
aaaggtttctatctgaatga

SEQ ID NO: 1503 - DNA, 20 bp, Artificial sequence
  Synthetic Oligonucleotide
ggaattctataattctgaaa

SEQ ID NO: 1504 - DNA, 20 bp, Artificial sequence
  Synthetic Oligonucleotide
atggtcttggtaggagctgt

SEQ ID NO: 1505 - DNA, 20 bp, Artificial sequence
  Synthetic Oligonucleotide
tttatcctcatggtcttggt

SEQ ID NO: 1506 - DNA, 20 bp, Artificial sequence
  Synthetic Oligonucleotide
tgttagatatttatcctcat

SEQ ID NO: 1507 - DNA, 20 bp, Artificial sequence
  Synthetic Oligonucleotide
gctcctttctccttcagcaa

SEQ ID NO: 1508 - DNA, 20 bp, Artificial sequence
  Synthetic Oligonucleotide
ataactaaagctcctttctc

SEQ ID NO: 1509 - DNA, 20 bp, Artificial sequence
  Synthetic Oligonucleotide
ttatccatcataactaaagc

SEQ ID NO: 1510 - DNA, 20 bp, Artificial sequence
  Synthetic Oligonucleotide
cagatatttttatccatcat

SEQ ID NO: 1511 - DNA, 20 bp, Artificial sequence
  Synthetic Oligonucleotide
tttggaagcctagggtggca

SEQ ID NO: 1512 - DNA, 20 bp, Artificial sequence
  Synthetic Oligonucleotide
taagtataatttggaagcct

SEQ ID NO: 1513 - DNA, 20 bp, Artificial sequence
  Synthetic Oligonucleotide
taaacaatttaagtataatt

SEQ ID NO: 1514 - DNA, 20 bp, Artificial sequence
  Synthetic Oligonucleotide
tgatactcctattgtggtaa

SEQ ID NO: 1515 - DNA, 20 bp, Artificial sequence
  Synthetic Oligonucleotide
atttggccctgatactccta

SEQ ID NO: 1516 - DNA, 20 bp, Artificial sequence
  Synthetic Oligonucleotide
tacataggtatttggccctg

SEQ ID NO: 1517 - DNA, 20 bp, Artificial sequence
  Synthetic Oligonucleotide
ctaaagcagaaatgacctca

SEQ ID NO: 1518 - DNA, 20 bp, Artificial sequence
  Synthetic Oligonucleotide
gtacttttcctaaagcagaa

SEQ ID NO: 1519 - DNA, 20 bp, Artificial sequence
  Synthetic Oligonucleotide
ttaccgaaagtacttttcct

SEQ ID NO: 1520 - DNA, 20 bp, Artificial sequence
  Synthetic Oligonucleotide
tctgaaataatgaatactgg

SEQ ID NO: 1521 - DNA, 20 bp, Artificial sequence
  Synthetic Oligonucleotide
agggaattatctgaaataat

SEQ ID NO: 1522 - DNA, 20 bp, Artificial sequence
  Synthetic Oligonucleotide
attaaatgtactagttgtcc

SEQ ID NO: 1523 - DNA, 20 bp, Artificial sequence
  Synthetic Oligonucleotide
tctgagaatattaaatgtac

SEQ ID NO: 1524 - DNA, 20 bp, Artificial sequence
  Synthetic Oligonucleotide
gccataagttctgagaatat

SEQ ID NO: 1525 - DNA, 20 bp, Artificial sequence
  Synthetic Oligonucleotide
tagtaaaatgccataagttc

SEQ ID NO: 1526 - DNA, 20 bp, Artificial sequence
  Synthetic Oligonucleotide
cacatagtaaaatgccataa

SEQ ID NO: 1527 - DNA, 20 bp, Artificial sequence
  Synthetic Oligonucleotide
tcacatagtaaaatgccata

SEQ ID NO: 1528 - DNA, 20 bp, Artificial sequence
  Synthetic Oligonucleotide
ttcacatagtaaaatgccat

SEQ ID NO: 1529 - DNA, 20 bp, Artificial sequence
  Synthetic Oligonucleotide
tttcacatagtaaaatgcca

SEQ ID NO: 1530 - DNA, 20 bp, Artificial sequence
  Synthetic Oligonucleotide
ttttcacatagtaaaatgcc

SEQ ID NO: 1531 - DNA, 20 bp, Artificial sequence
  Synthetic Oligonucleotide
agttttcacatagtaaaatg

SEQ ID NO: 1532 - DNA, 20 bp, Artificial sequence
  Synthetic Oligonucleotide
aagttttcacatagtaaaat

SEQ ID NO: 1533 - DNA, 20 bp, Artificial sequence
  Synthetic Oligonucleotide
aaagttttcacatagtaaaa

SEQ ID NO: 1534 - DNA, 20 bp, Artificial sequence
  Synthetic Oligonucleotide
taaagttttcacatagtaaa

SEQ ID NO: 1535 - DNA, 20 bp, Artificial sequence
  Synthetic Oligonucleotide
ttaaagttttcacatagtaa

SEQ ID NO: 1536 - DNA, 20 bp, Artificial sequence
  Synthetic Oligonucleotide
taaatttaaagttttcacat

SEQ ID NO: 1537 - DNA, 20 bp, Artificial sequence
  Synthetic Oligonucleotide
ttacccttaatataaataaa

SEQ ID NO: 1538 - DNA, 20 bp, Artificial sequence
  Synthetic Oligonucleotide
agaatttgattacccttaat

SEQ ID NO: 1539 - DNA, 20 bp, Artificial sequence
  Synthetic Oligonucleotide
gaaaatctttcatctttaag

SEQ ID NO: 1540 - DNA, 20 bp, Artificial sequence
  Synthetic Oligonucleotide
cctttaaaatacagaaaatc

SEQ ID NO: 1541 - DNA, 20 bp, Artificial sequence
  Synthetic Oligonucleotide
gcatagcttcctttaaaata

SEQ ID NO: 1542 - DNA, 20 bp, Artificial sequence
  Synthetic Oligonucleotide
gttaattacataacaagtta

SEQ ID NO: 1543 - DNA, 20 bp, Artificial sequence
  Synthetic Oligonucleotide
tattatatatgatttttttg

SEQ ID NO: 1544 - DNA, 20 bp, Artificial sequence
  Synthetic Oligonucleotide
gagataacactggaacaaag

SEQ ID NO: 1545 - DNA, 20 bp, Artificial sequence
  Synthetic Oligonucleotide
acaatgaaagagataacact

SEQ ID NO: 1546 - DNA, 20 bp, Artificial sequence
  Synthetic Oligonucleotide
caaatacaaagtaacaatga

SEQ ID NO: 1547 - DNA, 20 bp, Artificial sequence
  Synthetic Oligonucleotide
gtattcatttttttaatttg

SEQ ID NO: 1548 - DNA, 20 bp, Artificial sequence
  Synthetic Oligonucleotide
tacctgctgcacactcgcga

SEQ ID NO: 1549 - DNA, 20 bp, Artificial sequence
  Synthetic Oligonucleotide
atccaagatacatagcaaat

SEQ ID NO: 1550 - DNA, 20 bp, Artificial sequence
  Synthetic Oligonucleotide
taatagtcagatggaaaata

SEQ ID NO: 1551 - DNA, 20 bp, Artificial sequence
  Synthetic Oligonucleotide
tatcaagcaggagtgactct

SEQ ID NO: 1552 - DNA, 20 bp, Artificial sequence
  Synthetic Oligonucleotide
ctctctaggcagaaatacta

SEQ ID NO: 1553 - DNA, 20 bp, Artificial sequence
  Synthetic Oligonucleotide
atactttgcctctggtactc

SEQ ID NO: 1554 - DNA, 20 bp, Artificial sequence
  Synthetic Oligonucleotide
caactatgatatatccaaaa

SEQ ID NO: 1555 - DNA, 20 bp, Artificial sequence
  Synthetic Oligonucleotide
aaaagataggcaggaaaaga

SEQ ID NO: 1556 - DNA, 20 bp, Artificial sequence
  Synthetic Oligonucleotide
tgccaaactcatctctgtac

SEQ ID NO: 1557 - DNA, 20 bp, Artificial sequence
  Synthetic Oligonucleotide
gtaaacaacggctattttag

SEQ ID NO: 1558 - DNA, 20 bp, Artificial sequence
  Synthetic Oligonucleotide
cccagaaacaaaagcaagcc

SEQ ID NO: 1559 - DNA, 20 bp, Artificial sequence
  Synthetic Oligonucleotide
gtactgaaaacaagaagagc

SEQ ID NO: 1560 - DNA, 20 bp, Artificial sequence
  Synthetic Oligonucleotide
ggacatttaaagttacaatt

SEQ ID NO: 1561 - DNA, 20 bp, Artificial sequence
  Synthetic Oligonucleotide
tcttcttcacaactgcatgg

SEQ ID NO: 1562 - DNA, 20 bp, Artificial sequence
  Synthetic Oligonucleotide
tttacattattggaagaaga

SEQ ID NO: 1563 - DNA, 20 bp, Artificial sequence
  Synthetic Oligonucleotide
ctttacattattggaagaag

SEQ ID NO: 1564 - DNA, 20 bp, Artificial sequence
  Synthetic Oligonucleotide
gctttacattattggaagaa

SEQ ID NO: 1565 - DNA, 20 bp, Artificial sequence
  Synthetic Oligonucleotide
ggctttacattattggaaga

SEQ ID NO: 1566 - DNA, 20 bp, Artificial sequence
  Synthetic Oligonucleotide
tggctttacattattggaag

SEQ ID NO: 1567 - DNA, 20 bp, Artificial sequence
  Synthetic Oligonucleotide
tttggctttacattattgga

SEQ ID NO: 1568 - DNA, 20 bp, Artificial sequence
  Synthetic Oligonucleotide
gtttggctttacattattgg

SEQ ID NO: 1569 - DNA, 20 bp, Artificial sequence
  Synthetic Oligonucleotide
tgtttggctttacattattg

SEQ ID NO: 1570 - DNA, 20 bp, Artificial sequence
  Synthetic Oligonucleotide
ttgtttggctttacattatt

SEQ ID NO: 1571 - DNA, 20 bp, Artificial sequence
  Synthetic Oligonucleotide
attgtttggctttacattat

SEQ ID NO: 1572 - DNA, 20 bp, Artificial sequence
  Synthetic Oligonucleotide
gaataattcacaatgtacac

SEQ ID NO: 1573 - DNA, 20 bp, Artificial sequence
  Synthetic Oligonucleotide
catgtgtgtttgtttctttc

SEQ ID NO: 1574 - DNA, 20 bp, Artificial sequence
  Synthetic Oligonucleotide
attcaaaccttcccaatcac

SEQ ID NO: 1575 - DNA, 20 bp, Artificial sequence
  Synthetic Oligonucleotide
tccatcgccaaatggagaat

SEQ ID NO: 1576 - DNA, 20 bp, Artificial sequence
  Synthetic Oligonucleotide
aatactggaataggagtagt

SEQ ID NO: 1577 - DNA, 20 bp, Artificial sequence
  Synthetic Oligonucleotide
tctcatgatccttagtatga

SEQ ID NO: 1578 - DNA, 20 bp, Artificial sequence
  Synthetic Oligonucleotide
acctggcctactcctgttcc

SEQ ID NO: 1579 - DNA, 20 bp, Artificial sequence
  Synthetic Oligonucleotide
atgcatattagtctttttcc

SEQ ID NO: 1580 - DNA, 20 bp, Artificial sequence
  Synthetic Oligonucleotide
ctgccactgtaatcacctct

SEQ ID NO: 1581 - DNA, 20 bp, Artificial sequence
  Synthetic Oligonucleotide
tacatattgtctaataatcc

SEQ ID NO: 1582 - DNA, 20 bp, Artificial sequence
  Synthetic Oligonucleotide
tttgttggcagtgatgtctc

SEQ ID NO: 1583 - DNA, 20 bp, Artificial sequence
  Synthetic Oligonucleotide
ttaaaaacttttgatttctt

SEQ ID NO: 1584 - DNA, 20 bp, Artificial sequence
  Synthetic Oligonucleotide
aagggcaaccaatgtacaag

SEQ ID NO: 1585 - DNA, 20 bp, Artificial sequence
  Synthetic Oligonucleotide
tatgacctgtttcctccatt

SEQ ID NO: 1586 - DNA, 20 bp, Artificial sequence
  Synthetic Oligonucleotide
ctatgacctgtttcctccat

SEQ ID NO: 1587 - DNA, 20 bp, Artificial sequence
  Synthetic Oligonucleotide
gctatgacctgtttcctcca

SEQ ID NO: 1588 - DNA, 20 bp, Artificial sequence
  Synthetic Oligonucleotide
agctatgacctgtttcctcc

SEQ ID NO: 1589 - DNA, 20 bp, Artificial sequence
  Synthetic Oligonucleotide
cagctatgacctgtttcctc

SEQ ID NO: 1590 - DNA, 20 bp, Artificial sequence
  Synthetic Oligonucleotide
atcagctatgacctgtttcc

SEQ ID NO: 1591 - DNA, 20 bp, Artificial sequence
  Synthetic Oligonucleotide
aatcagctatgacctgtttc

SEQ ID NO: 1592 - DNA, 20 bp, Artificial sequence
  Synthetic Oligonucleotide
aaaatcagctatgacctgtt

SEQ ID NO: 1593 - DNA, 20 bp, Artificial sequence
  Synthetic Oligonucleotide
taaaatcagctatgacctgt

SEQ ID NO: 1594 - DNA, 20 bp, Artificial sequence
  Synthetic Oligonucleotide
atgtggtgaatattatagaa

SEQ ID NO: 1595 - DNA, 20 bp, Artificial sequence
  Synthetic Oligonucleotide
ctttattgaaaattgccaca

SEQ ID NO: 1596 - DNA, 20 bp, Artificial sequence
  Synthetic Oligonucleotide
catttaagttggatagtgag

SEQ ID NO: 1597 - DNA, 20 bp, Artificial sequence
  Synthetic Oligonucleotide
ggaataaaatatacaatata

SEQ ID NO: 1598 - DNA, 20 bp, Artificial sequence
  Synthetic Oligonucleotide
agttcttcttaaaatgatcc

SEQ ID NO: 1599 - DNA, 20 bp, Artificial sequence
  Synthetic Oligonucleotide
aagcccacattgaaaaaaca

SEQ ID NO: 1600 - DNA, 20 bp, Artificial sequence
  Synthetic Oligonucleotide
tgaaaataaacagagaagat

SEQ ID NO: 1601 - DNA, 20 bp, Artificial sequence
  Synthetic Oligonucleotide
atgtgaaaataaacagagaa

SEQ ID NO: 1602 - DNA, 20 bp, Artificial sequence
  Synthetic Oligonucleotide
agcctagaagcagttggttt

SEQ ID NO: 1603 - DNA, 20 bp, Artificial sequence
  Synthetic Oligonucleotide
aataataacaatatcccatc

SEQ ID NO: 1604 - DNA, 20 bp, Artificial sequence
  Synthetic Oligonucleotide
aagattgatgaaccacagga

SEQ ID NO: 1605 - DNA, 20 bp, Artificial sequence
  Synthetic Oligonucleotide
atttcatcccttactgctta

SEQ ID NO: 1606 - DNA, 20 bp, Artificial sequence
  Synthetic Oligonucleotide
agagataatcaagagaaaaa

SEQ ID NO: 1607 - DNA, 20 bp, Artificial sequence
  Synthetic Oligonucleotide
agtatggagctcctttacca

SEQ ID NO: 1608 - DNA, 20 bp, Artificial sequence
  Synthetic Oligonucleotide
tacattgagatgtgtatatt

SEQ ID NO: 1609 - DNA, 20 bp, Artificial sequence
  Synthetic Oligonucleotide
tgctttaggagaagccttgg

SEQ ID NO: 1610 - DNA, 20 bp, Artificial sequence
  Synthetic Oligonucleotide
gtgctttaggagaagccttg

SEQ ID NO: 1611 - DNA, 20 bp, Artificial sequence
  Synthetic Oligonucleotide
tgtgctttaggagaagcctt

SEQ ID NO: 1612 - DNA, 20 bp, Artificial sequence
  Synthetic Oligonucleotide
gtgtgctttaggagaagcct

SEQ ID NO: 1613 - DNA, 20 bp, Artificial sequence
  Synthetic Oligonucleotide
ggtgtgctttaggagaagcc

SEQ ID NO: 1614 - DNA, 20 bp, Artificial sequence
  Synthetic Oligonucleotide
gaggtgtgctttaggagaag

SEQ ID NO: 1615 - DNA, 20 bp, Artificial sequence
  Synthetic Oligonucleotide
tgaggtgtgctttaggagaa

SEQ ID NO: 1616 - DNA, 20 bp, Artificial sequence
  Synthetic Oligonucleotide
atgaggtgtgctttaggaga

SEQ ID NO: 1617 - DNA, 20 bp, Artificial sequence
  Synthetic Oligonucleotide
aatgaggtgtgctttaggag

SEQ ID NO: 1618 - DNA, 20 bp, Artificial sequence
  Synthetic Oligonucleotide
gaatgaggtgtgctttagga

SEQ ID NO: 1619 - DNA, 20 bp, Artificial sequence
  Synthetic Oligonucleotide
attttaaaacgatcagccag

SEQ ID NO: 1620 - DNA, 20 bp, Artificial sequence
  Synthetic Oligonucleotide
agttgggaactcatcatagg

SEQ ID NO: 1621 - DNA, 20 bp, Artificial sequence
  Synthetic Oligonucleotide
aggctcacggatatgaaaca

SEQ ID NO: 1622 - DNA, 20 bp, Artificial sequence
  Synthetic Oligonucleotide
aagagaggaaaaactgaaaa

SEQ ID NO: 1623 - DNA, 20 bp, Artificial sequence
  Synthetic Oligonucleotide
gtttacacatagaagtccgg

SEQ ID NO: 1624 - DNA, 20 bp, Artificial sequence
  Synthetic Oligonucleotide
taaagggatacaagccattt

SEQ ID NO: 1625 - DNA, 20 bp, Artificial sequence
  Synthetic Oligonucleotide
tccttgagagcagcccctgt

SEQ ID NO: 1626 - DNA, 20 bp, Artificial sequence
  Synthetic Oligonucleotide
attcgagaacagcgattccc

SEQ ID NO: 1627 - DNA, 20 bp, Artificial sequence
  Synthetic Oligonucleotide
actgaacaaagacatcaggg

SEQ ID NO: 1628 - DNA, 20 bp, Artificial sequence
  Synthetic Oligonucleotide
atgaacgagctactcaagtt

SEQ ID NO: 1629 - DNA, 20 bp, Artificial sequence
  Synthetic Oligonucleotide
aagaaagttgatgaacgagc

SEQ ID NO: 1630 - DNA, 20 bp, Artificial sequence
  Synthetic Oligonucleotide
cctgccaatgtagccatttt

SEQ ID NO: 1631 - DNA, 20 bp, Artificial sequence
  Synthetic Oligonucleotide
gaataggaaaaatgtcacac

SEQ ID NO: 1632 - DNA, 20 bp, Artificial sequence
  Synthetic Oligonucleotide
gtcttactcaatagtcacct

SEQ ID NO: 1633 - DNA, 20 bp, Artificial sequence
  Synthetic Oligonucleotide
tcttgatctcatccactcca

SEQ ID NO: 1634 - DNA, 20 bp, Artificial sequence
  Synthetic Oligonucleotide
caagtgtcttatgtttttct

SEQ ID NO: 1635 - DNA, 20 bp, Artificial sequence
  Synthetic Oligonucleotide
gattttatcttttataactt

SEQ ID NO: 1636 - DNA, 20 bp, Artificial sequence
  Synthetic Oligonucleotide
tctgtttacttatcagtctc

SEQ ID NO: 1637 - DNA, 20 bp, Artificial sequence
  Synthetic Oligonucleotide
gcagtaggtactatgaactt

SEQ ID NO: 1638 - DNA, 20 bp, Artificial sequence
  Synthetic Oligonucleotide
cttgaactcaggtcatggca

SEQ ID NO: 1639 - DNA, 20 bp, Artificial sequence
  Synthetic Oligonucleotide
ctcacccccgaccatgtgca

SEQ ID NO: 1640 - DNA, 20 bp, Artificial sequence
  Synthetic Oligonucleotide
cacaatgctattgtctttag

SEQ ID NO: 1641 - DNA, 20 bp, Artificial sequence
  Synthetic Oligonucleotide
cataatgtacatctttgcca

SEQ ID NO: 1642 - DNA, 20 bp, Artificial sequence
  Synthetic Oligonucleotide
aatgtctatataacaagtta

SEQ ID NO: 1643 - DNA, 20 bp, Artificial sequence
  Synthetic Oligonucleotide
tatatcccttcttaaagaat

SEQ ID NO: 1644 - DNA, 20 bp, Artificial sequence
  Synthetic Oligonucleotide
cgtgtggactgtaaattttt

SEQ ID NO: 1645 - DNA, 20 bp, Artificial sequence
  Synthetic Oligonucleotide
catcatgctacatgtaatgg

SEQ ID NO: 1646 - DNA, 20 bp, Artificial sequence
  Synthetic Oligonucleotide
tgctgggaatactatggtaa

SEQ ID NO: 1647 - DNA, 20 bp, Artificial sequence
  Synthetic Oligonucleotide
attccaattacatgccaagg

SEQ ID NO: 1648 - DNA, 20 bp, Artificial sequence
  Synthetic Oligonucleotide
atctgcattaatgcaaactg

SEQ ID NO: 1649 - DNA, 20 bp, Artificial sequence
  Synthetic Oligonucleotide
attcttctggcatgcctaaa

SEQ ID NO: 1650 - DNA, 20 bp, Artificial sequence
  Synthetic Oligonucleotide
tcatcttatgtctctaacca

SEQ ID NO: 1651 - DNA, 20 bp, Artificial sequence
  Synthetic Oligonucleotide
tactttgctgagtaccatcc

SEQ ID NO: 1652 - DNA, 20 bp, Artificial sequence
  Synthetic Oligonucleotide
aggaagtaaccatgtcctca

SEQ ID NO: 1653 - DNA, 20 bp, Artificial sequence
  Synthetic Oligonucleotide
aaggaagtaaccatgtcctc

SEQ ID NO: 1654 - DNA, 20 bp, Artificial sequence
  Synthetic Oligonucleotide
aaaggaagtaaccatgtcct

SEQ ID NO: 1655 - DNA, 20 bp, Artificial sequence
  Synthetic Oligonucleotide
aaaaggaagtaaccatgtcc

SEQ ID NO: 1656 - DNA, 20 bp, Artificial sequence
  Synthetic Oligonucleotide
taaaaggaagtaaccatgtc

SEQ ID NO: 1657 - DNA, 20 bp, Artificial sequence
  Synthetic Oligonucleotide
attaaaaggaagtaaccatg

SEQ ID NO: 1658 - DNA, 20 bp, Artificial sequence
  Synthetic Oligonucleotide
tattaaaaggaagtaaccat

SEQ ID NO: 1659 - DNA, 20 bp, Artificial sequence
  Synthetic Oligonucleotide
gtattaaaaggaagtaacca

SEQ ID NO: 1660 - DNA, 20 bp, Artificial sequence
  Synthetic Oligonucleotide
ggtattaaaaggaagtaacc

SEQ ID NO: 1661 - DNA, 20 bp, Artificial sequence
  Synthetic Oligonucleotide
aggtattaaaaggaagtaac

SEQ ID NO: 1662 - DNA, 20 bp, Artificial sequence
  Synthetic Oligonucleotide
tatgtatccaaacatggatt

SEQ ID NO: 1663 - DNA, 20 bp, Artificial sequence
  Synthetic Oligonucleotide
ggtgacaaagtcttcatctg

SEQ ID NO: 1664 - DNA, 20 bp, Artificial sequence
  Synthetic Oligonucleotide
tttatttgagtctatttcct

SEQ ID NO: 1665 - DNA, 20 bp, Artificial sequence
  Synthetic Oligonucleotide
gggtgcatagtctgtaggta

SEQ ID NO: 1666 - DNA, 20 bp, Artificial sequence
  Synthetic Oligonucleotide
ggatttcaagagaaaaaatc

SEQ ID NO: 1667 - DNA, 20 bp, Artificial sequence
  Synthetic Oligonucleotide
atatctttaccatgtatatg

SEQ ID NO: 1668 - DNA, 20 bp, Artificial sequence
  Synthetic Oligonucleotide
tccaaactcagaatgcacca

SEQ ID NO: 1669 - DNA, 20 bp, Artificial sequence
  Synthetic Oligonucleotide
gtctatgagtaatggcatgg

SEQ ID NO: 1670 - DNA, 20 bp, Artificial sequence
  Synthetic Oligonucleotide
ggattaaaatcaatttatca

SEQ ID NO: 1671 - DNA, 20 bp, Artificial sequence
  Synthetic Oligonucleotide
aatttcttttggcttgatac

SEQ ID NO: 1672 - DNA, 20 bp, Artificial sequence
  Synthetic Oligonucleotide
ttcaaattatgcgaatctga

SEQ ID NO: 1673 - DNA, 20 bp, Artificial sequence
  Synthetic Oligonucleotide
ttggacatcatttcatttat

SEQ ID NO: 1674 - DNA, 20 bp, Artificial sequence
  Synthetic Oligonucleotide
accttaaaagcccaggatct

SEQ ID NO: 1675 - DNA, 20 bp, Artificial sequence
  Synthetic Oligonucleotide
actttaaagatgcagaaata

SEQ ID NO: 1676 - DNA, 20 bp, Artificial sequence
  Synthetic Oligonucleotide
aactttaaagatgcagaaat

SEQ ID NO: 1677 - DNA, 20 bp, Artificial sequence
  Synthetic Oligonucleotide
aaactttaaagatgcagaaa

SEQ ID NO: 1678 - DNA, 20 bp, Artificial sequence
  Synthetic Oligonucleotide
caaactttaaagatgcagaa

SEQ ID NO: 1679 - DNA, 20 bp, Artificial sequence
  Synthetic Oligonucleotide
ccaaactttaaagatgcaga

SEQ ID NO: 1680 - DNA, 20 bp, Artificial sequence
  Synthetic Oligonucleotide
tgccaaactttaaagatgca

SEQ ID NO: 1681 - DNA, 20 bp, Artificial sequence
  Synthetic Oligonucleotide
ttgccaaactttaaagatgc

SEQ ID NO: 1682 - DNA, 20 bp, Artificial sequence
  Synthetic Oligonucleotide
tttgccaaactttaaagatg

SEQ ID NO: 1683 - DNA, 20 bp, Artificial sequence
  Synthetic Oligonucleotide
gtttgccaaactttaaagat

SEQ ID NO: 1684 - DNA, 20 bp, Artificial sequence
  Synthetic Oligonucleotide
ggtttgccaaactttaaaga

SEQ ID NO: 1685 - DNA, 20 bp, Artificial sequence
  Synthetic Oligonucleotide
ccaaatatgtttcaccccag

SEQ ID NO: 1686 - DNA, 20 bp, Artificial sequence
  Synthetic Oligonucleotide
agcatttttacaattaagga

SEQ ID NO: 1687 - DNA, 20 bp, Artificial sequence
  Synthetic Oligonucleotide
catactttagtctgtatttc

SEQ ID NO: 1688 - DNA, 20 bp, Artificial sequence
  Synthetic Oligonucleotide
ttattatatatcatgtttta

SEQ ID NO: 1689 - DNA, 20 bp, Artificial sequence
  Synthetic Oligonucleotide
gttattatatatcatgtttt

SEQ ID NO: 1690 - DNA, 20 bp, Artificial sequence
  Synthetic Oligonucleotide
agttattatatatcatgttt

SEQ ID NO: 1691 - DNA, 20 bp, Artificial sequence
  Synthetic Oligonucleotide
cagttattatatatcatgtt

SEQ ID NO: 1692 - DNA, 20 bp, Artificial sequence
  Synthetic Oligonucleotide
acagttattatatatcatgt

SEQ ID NO: 1693 - DNA, 20 bp, Artificial sequence
  Synthetic Oligonucleotide
agacagttattatatatcat

SEQ ID NO: 1694 - DNA, 20 bp, Artificial sequence
  Synthetic Oligonucleotide
aagacagttattatatatca

SEQ ID NO: 1695 - DNA, 20 bp, Artificial sequence
  Synthetic Oligonucleotide
aaagacagttattatatatc

SEQ ID NO: 1696 - DNA, 20 bp, Artificial sequence
  Synthetic Oligonucleotide
caaagacagttattatatat

SEQ ID NO: 1697 - DNA, 20 bp, Artificial sequence
  Synthetic Oligonucleotide
acaaagacagttattatata

SEQ ID NO: 1698 - DNA, 20 bp, Artificial sequence
  Synthetic Oligonucleotide
ttcctgagtcagctgggcac

SEQ ID NO: 1699 - DNA, 20 bp, Artificial sequence
  Synthetic Oligonucleotide
gttgagtgtagttgagaagc

SEQ ID NO: 1700 - DNA, 20 bp, Artificial sequence
  Synthetic Oligonucleotide
aaagatgcttgtctaaagcc

SEQ ID NO: 1701 - DNA, 20 bp, Artificial sequence
  Synthetic Oligonucleotide
aataaatactccctctctct

SEQ ID NO: 1702 - DNA, 20 bp, Artificial sequence
  Synthetic Oligonucleotide
actaaaaagagtggaaatga

SEQ ID NO: 1703 - DNA, 20 bp, Artificial sequence
  Synthetic Oligonucleotide
ggcaaacatagtactttatt

SEQ ID NO: 1704 - DNA, 20 bp, Artificial sequence
  Synthetic Oligonucleotide
tgttgcttgcttaaaagaaa

SEQ ID NO: 1705 - DNA, 20 bp, Artificial sequence
  Synthetic Oligonucleotide
tactgctcacagatatttat

SEQ ID NO: 1706 - DNA, 20 bp, Artificial sequence
  Synthetic Oligonucleotide
ctcttgtcaatgccctacac

SEQ ID NO: 1707 - DNA, 20 bp, Artificial sequence
  Synthetic Oligonucleotide
gcaaaaaggtgttcattctt

SEQ ID NO: 1708 - DNA, 20 bp, Artificial sequence
  Synthetic Oligonucleotide
acttttcacccagcaaaaag

SEQ ID NO: 1709 - DNA, 20 bp, Artificial sequence
  Synthetic Oligonucleotide
atgctatttctattacccca

SEQ ID NO: 1710 - DNA, 20 bp, Artificial sequence
  Synthetic Oligonucleotide
accttcctctaaatgttatg

SEQ ID NO: 1711 - DNA, 20 bp, Artificial sequence
  Synthetic Oligonucleotide
ctgtcctgcctttatttgtg

SEQ ID NO: 1712 - DNA, 20 bp, Artificial sequence
  Synthetic Oligonucleotide
tgttacttacttgtttgttt

SEQ ID NO: 1713 - DNA, 20 bp, Artificial sequence
  Synthetic Oligonucleotide
ttgacttcatggtactaaca

SEQ ID NO: 1714 - DNA, 20 bp, Artificial sequence
  Synthetic Oligonucleotide
caaagcattccacaacatgt

SEQ ID NO: 1715 - DNA, 20 bp, Artificial sequence
  Synthetic Oligonucleotide
tgcattttcatcaacattag

SEQ ID NO: 1716 - DNA, 20 bp, Artificial sequence
  Synthetic Oligonucleotide
tttttggcataagactagtt

SEQ ID NO: 1717 - DNA, 20 bp, Artificial sequence
  Synthetic Oligonucleotide
tctatgtttttttaactggg

SEQ ID NO: 1718 - DNA, 20 bp, Artificial sequence
  Synthetic Oligonucleotide
caacagtaggaatagcaata

SEQ ID NO: 1719 - DNA, 20 bp, Artificial sequence
  Synthetic Oligonucleotide
gtttgctgagtgattcatta

SEQ ID NO: 1720 - DNA, 20 bp, Artificial sequence
  Synthetic Oligonucleotide
aatggtttgacttgagacac

SEQ ID NO: 1721 - DNA, 20 bp, Artificial sequence
  Synthetic Oligonucleotide
aattttcaaagcgcatgaaa

SEQ ID NO: 1722 - DNA, 20 bp, Artificial sequence
  Synthetic Oligonucleotide
ttaattttcaaagcgcatga

SEQ ID NO: 1723 - DNA, 20 bp, Artificial sequence
  Synthetic Oligonucleotide
gttaattttcaaagcgcatg

SEQ ID NO: 1724 - DNA, 20 bp, Artificial sequence
  Synthetic Oligonucleotide
tgttaattttcaaagcgcat

SEQ ID NO: 1725 - DNA, 20 bp, Artificial sequence
  Synthetic Oligonucleotide
tatgttaattttcaaagcgc

SEQ ID NO: 1726 - DNA, 20 bp, Artificial sequence
  Synthetic Oligonucleotide
atatgttaattttcaaagcg

SEQ ID NO: 1727 - DNA, 20 bp, Artificial sequence
  Synthetic Oligonucleotide
aatatgttaattttcaaagc

SEQ ID NO: 1728 - DNA, 20 bp, Artificial sequence
  Synthetic Oligonucleotide
gaatatgttaattttcaaag

SEQ ID NO: 1729 - DNA, 20 bp, Artificial sequence
  Synthetic Oligonucleotide
tgaatatgttaattttcaaa

SEQ ID NO: 1730 - DNA, 20 bp, Artificial sequence
  Synthetic Oligonucleotide
agaatgctcatgtactgctg

SEQ ID NO: 1731 - DNA, 20 bp, Artificial sequence
  Synthetic Oligonucleotide
cagaatgctcatgtactgct

SEQ ID NO: 1732 - DNA, 20 bp, Artificial sequence
  Synthetic Oligonucleotide
ctgtcacaacttctatctag

SEQ ID NO: 1733 - DNA, 20 bp, Artificial sequence
  Synthetic Oligonucleotide
gtttcttaagtgggatacaa

SEQ ID NO: 1734 - DNA, 20 bp, Artificial sequence
  Synthetic Oligonucleotide
acttaaaatgttttagacct

SEQ ID NO: 1735 - DNA, 20 bp, Artificial sequence
  Synthetic Oligonucleotide
aatacctcagcagatgctga

SEQ ID NO: 1736 - DNA, 20 bp, Artificial sequence
  Synthetic Oligonucleotide
cacattactaaaactgactt

SEQ ID NO: 1737 - DNA, 20 bp, Artificial sequence
  Synthetic Oligonucleotide
aaaccagtgttctaagcttc

SEQ ID NO: 1738 - DNA, 20 bp, Artificial sequence
  Synthetic Oligonucleotide
aaatgatactaactgcaaac

SEQ ID NO: 1739 - DNA, 20 bp, Artificial sequence
  Synthetic Oligonucleotide
aagaaaatgatactaactgc

SEQ ID NO: 1740 - DNA, 20 bp, Artificial sequence
  Synthetic Oligonucleotide
taatctgcatatgggtttct

SEQ ID NO: 1741 - DNA, 20 bp, Artificial sequence
  Synthetic Oligonucleotide
agattattaaattatcataa

SEQ ID NO: 1742 - DNA, 20 bp, Artificial sequence
  Synthetic Oligonucleotide
tatttgaatttcatgtttca

SEQ ID NO: 1743 - DNA, 20 bp, Artificial sequence
  Synthetic Oligonucleotide
tttttatggagaccgctgga

SEQ ID NO: 1744 - DNA, 20 bp, Artificial sequence
  Synthetic Oligonucleotide
gtccattccctttgtaaaat

SEQ ID NO: 1745 - DNA, 20 bp, Artificial sequence
  Synthetic Oligonucleotide
tggaaatttcacagtccatt

SEQ ID NO: 1746 - DNA, 20 bp, Artificial sequence
  Synthetic Oligonucleotide
tcattaaccaaactactttt

SEQ ID NO: 1747 - DNA, 20 bp, Artificial sequence
  Synthetic Oligonucleotide
attatgaggataaaagaaaa

SEQ ID NO: 1748 - DNA, 20 bp, Artificial sequence
  Synthetic Oligonucleotide
aattatgaggataaaagaaa

SEQ ID NO: 1749 - DNA, 20 bp, Artificial sequence
  Synthetic Oligonucleotide
caattatgaggataaaagaa

SEQ ID NO: 1750 - DNA, 20 bp, Artificial sequence
  Synthetic Oligonucleotide
ccaattatgaggataaaaga

SEQ ID NO: 1751 - DNA, 20 bp, Artificial sequence
  Synthetic Oligonucleotide
cccaattatgaggataaaag

SEQ ID NO: 1752 - DNA, 20 bp, Artificial sequence
  Synthetic Oligonucleotide
aacccaattatgaggataaa

SEQ ID NO: 1753 - DNA, 20 bp, Artificial sequence
  Synthetic Oligonucleotide
gaacccaattatgaggataa

SEQ ID NO: 1754 - DNA, 20 bp, Artificial sequence
  Synthetic Oligonucleotide
agaacccaattatgaggata

SEQ ID NO: 1755 - DNA, 20 bp, Artificial sequence
  Synthetic Oligonucleotide
aagaacccaattatgaggat

SEQ ID NO: 1756 - DNA, 20 bp, Artificial sequence
  Synthetic Oligonucleotide
taagaacccaattatgagga

SEQ ID NO: 1757 - DNA, 20 bp, Artificial sequence
  Synthetic Oligonucleotide
agatctgtttccattgcctg

SEQ ID NO: 1758 - DNA, 20 bp, Artificial sequence
  Synthetic Oligonucleotide
ctttaagttacacattattt

SEQ ID NO: 1759 - DNA, 20 bp, Artificial sequence
  Synthetic Oligonucleotide
caaactatgttatactttaa

SEQ ID NO: 1760 - DNA, 20 bp, Artificial sequence
  Synthetic Oligonucleotide
actcttcagagtctgaaaag

SEQ ID NO: 1761 - DNA, 20 bp, Artificial sequence
  Synthetic Oligonucleotide
aactcttcagagtctgaaaa

SEQ ID NO: 1762 - DNA, 20 bp, Artificial sequence
  Synthetic Oligonucleotide
aaactcttcagagtctgaaa

SEQ ID NO: 1763 - DNA, 20 bp, Artificial sequence
  Synthetic Oligonucleotide
caaactcttcagagtctgaa

SEQ ID NO: 1764 - DNA, 20 bp, Artificial sequence
  Synthetic Oligonucleotide
tcaaactcttcagagtctga

SEQ ID NO: 1765 - DNA, 20 bp, Artificial sequence
  Synthetic Oligonucleotide
tgtcaaactcttcagagtct

SEQ ID NO: 1766 - DNA, 20 bp, Artificial sequence
  Synthetic Oligonucleotide
gtgtcaaactcttcagagtc

SEQ ID NO: 1767 - DNA, 20 bp, Artificial sequence
  Synthetic Oligonucleotide
atagttgggaacgaatagta

SEQ ID NO: 1768 - DNA, 20 bp, Artificial sequence
  Synthetic Oligonucleotide
tatagttgggaacgaatagt

SEQ ID NO: 1769 - DNA, 20 bp, Artificial sequence
  Synthetic Oligonucleotide
ttatagttgggaacgaatag

SEQ ID NO: 1770 - DNA, 20 bp, Artificial sequence
  Synthetic Oligonucleotide
cttatagttgggaacgaata

SEQ ID NO: 1771 - DNA, 20 bp, Artificial sequence
  Synthetic Oligonucleotide
tcttatagttgggaacgaat

SEQ ID NO: 1772 - DNA, 20 bp, Artificial sequence
  Synthetic Oligonucleotide
tgtcttatagttgggaacga

SEQ ID NO: 1773 - DNA, 20 bp, Artificial sequence
  Synthetic Oligonucleotide
atgtcttatagttgggaacg

SEQ ID NO: 1774 - DNA, 20 bp, Artificial sequence
  Synthetic Oligonucleotide
aatgtcttatagttgggaac

SEQ ID NO: 1775 - DNA, 20 bp, Artificial sequence
  Synthetic Oligonucleotide
gaatgtcttatagttgggaa

SEQ ID NO: 1776 - DNA, 20 bp, Artificial sequence
  Synthetic Oligonucleotide
agaatgtcttatagttggga

SEQ ID NO: 1777 - DNA, 20 bp, Artificial sequence
  Synthetic Oligonucleotide
taaggacagagaccgagttt

SEQ ID NO: 1778 - DNA, 20 bp, Artificial sequence
  Synthetic Oligonucleotide
catttacatgggattatttt

SEQ ID NO: 1779 - DNA, 20 bp, Artificial sequence
  Synthetic Oligonucleotide
atagctattatacctcacct

SEQ ID NO: 1780 - DNA, 20 bp, Artificial sequence
  Synthetic Oligonucleotide
attgttaagaaggaaatgca

SEQ ID NO: 1781 - DNA, 20 bp, Artificial sequence
  Synthetic Oligonucleotide
actctggtatattttatgat

SEQ ID NO: 1782 - DNA, 20 bp, Artificial sequence
  Synthetic Oligonucleotide
agagattgggaaacattcag

SEQ ID NO: 1783 - DNA, 20 bp, Artificial sequence
  Synthetic Oligonucleotide
tatagcaaaacaactatgaa

SEQ ID NO: 1784 - DNA, 20 bp, Artificial sequence
  Synthetic Oligonucleotide
ccccaaaatttcactcaaac

SEQ ID NO: 1785 - DNA, 20 bp, Artificial sequence
  Synthetic Oligonucleotide
tgtttgaaggaatagctgac

SEQ ID NO: 1786 - DNA, 20 bp, Artificial sequence
  Synthetic Oligonucleotide
gtgtttgaaggaatagctga

SEQ ID NO: 1787 - DNA, 20 bp, Artificial sequence
  Synthetic Oligonucleotide
tagtgtttgaaggaatagct

SEQ ID NO: 1788 - DNA, 20 bp, Artificial sequence
  Synthetic Oligonucleotide
atagtgtttgaaggaatagc

SEQ ID NO: 1789 - DNA, 20 bp, Artificial sequence
  Synthetic Oligonucleotide
ccatagtgtttgaaggaata

SEQ ID NO: 1790 - DNA, 20 bp, Artificial sequence
  Synthetic Oligonucleotide
gccatagtgtttgaaggaat

SEQ ID NO: 1791 - DNA, 20 bp, Artificial sequence
  Synthetic Oligonucleotide
aagccatagtgtttgaagga

SEQ ID NO: 1792 - DNA, 20 bp, Artificial sequence
  Synthetic Oligonucleotide
aaagccatagtgtttgaagg

SEQ ID NO: 1793 - DNA, 20 bp, Artificial sequence
  Synthetic Oligonucleotide
aaaaagccatagtgtttgaa

SEQ ID NO: 1794 - DNA, 20 bp, Artificial sequence
  Synthetic Oligonucleotide
taaaaagccatagtgtttga

SEQ ID NO: 1795 - DNA, 20 bp, Artificial sequence
  Synthetic Oligonucleotide
tctaaaaagccatagtgttt

SEQ ID NO: 1796 - DNA, 20 bp, Artificial sequence
  Synthetic Oligonucleotide
ttctaaaaagccatagtgtt

SEQ ID NO: 1797 - DNA, 20 bp, Artificial sequence
  Synthetic Oligonucleotide
atcatgcaagcagcatttta

SEQ ID NO: 1798 - DNA, 20 bp, Artificial sequence
  Synthetic Oligonucleotide
catcatgcaagcagcatttt

SEQ ID NO: 1799 - DNA, 20 bp, Artificial sequence
  Synthetic Oligonucleotide
gcatcatgcaagcagcattt

SEQ ID NO: 1800 - DNA, 20 bp, Artificial sequence
  Synthetic Oligonucleotide
agcatcatgcaagcagcatt

SEQ ID NO: 1801 - DNA, 20 bp, Artificial sequence
  Synthetic Oligonucleotide
cagcatcatgcaagcagcat

SEQ ID NO: 1802 - DNA, 20 bp, Artificial sequence
  Synthetic Oligonucleotide
tgcagcatcatgcaagcagc

SEQ ID NO: 1803 - DNA, 20 bp, Artificial sequence
  Synthetic Oligonucleotide
ttgcagcatcatgcaagcag

SEQ ID NO: 1804 - DNA, 20 bp, Artificial sequence
  Synthetic Oligonucleotide
cattgcagcatcatgcaagc

SEQ ID NO: 1805 - DNA, 20 bp, Artificial sequence
  Synthetic Oligonucleotide
tcattgcagcatcatgcaag

SEQ ID NO: 1806 - DNA, 20 bp, Artificial sequence
  Synthetic Oligonucleotide
ggagataataacagtggcta

SEQ ID NO: 1807 - DNA, 20 bp, Artificial sequence
  Synthetic Oligonucleotide
gtggaagtattaaggctact

SEQ ID NO: 1808 - DNA, 20 bp, Artificial sequence
  Synthetic Oligonucleotide
agtggaagtattaaggctac

SEQ ID NO: 1809 - DNA, 20 bp, Artificial sequence
  Synthetic Oligonucleotide
tagtggaagtattaaggcta

SEQ ID NO: 1810 - DNA, 20 bp, Artificial sequence
  Synthetic Oligonucleotide
ttagtggaagtattaaggct

SEQ ID NO: 1811 - DNA, 20 bp, Artificial sequence
  Synthetic Oligonucleotide
tttagtggaagtattaaggc

SEQ ID NO: 1812 - DNA, 20 bp, Artificial sequence
  Synthetic Oligonucleotide
tgtttagtggaagtattaag

SEQ ID NO: 1813 - DNA, 20 bp, Artificial sequence
  Synthetic Oligonucleotide
ttgtttagtggaagtattaa

SEQ ID NO: 1814 - DNA, 20 bp, Artificial sequence
  Synthetic Oligonucleotide
attgtttagtggaagtatta

SEQ ID NO: 1815 - DNA, 20 bp, Artificial sequence
  Synthetic Oligonucleotide
tattgtttagtggaagtatt

SEQ ID NO: 1816 - DNA, 20 bp, Artificial sequence
  Synthetic Oligonucleotide
ttattgtttagtggaagtat

SEQ ID NO: 1817 - DNA, 20 bp, Artificial sequence
  Synthetic Oligonucleotide
ttgtcatagttaagtaacag

SEQ ID NO: 1818 - DNA, 20 bp, Artificial sequence
  Synthetic Oligonucleotide
aaacaagtaatacagtatac

SEQ ID NO: 1819 - DNA, 20 bp, Artificial sequence
  Synthetic Oligonucleotide
atttcagatttacaacagag

SEQ ID NO: 1820 - DNA, 20 bp, Artificial sequence
  Synthetic Oligonucleotide
tgttaaagcttgataatagg

SEQ ID NO: 1821 - DNA, 20 bp, Artificial sequence
  Synthetic Oligonucleotide
agcaccaaattgttcctaac

SEQ ID NO: 1822 - DNA, 20 bp, Artificial sequence
  Synthetic Oligonucleotide
agcacacataatctatataa

SEQ ID NO: 1823 - DNA, 20 bp, Artificial sequence
  Synthetic Oligonucleotide
taccatctatcatcaataaa

SEQ ID NO: 1824 - DNA, 20 bp, Artificial sequence
  Synthetic Oligonucleotide
ttctctgacaacaatgacaa

SEQ ID NO: 1825 - DNA, 20 bp, Artificial sequence
  Synthetic Oligonucleotide
tgtctgcacagacacctgtt

SEQ ID NO: 1826 - DNA, 20 bp, Artificial sequence
  Synthetic Oligonucleotide
gtatctcttaacccagagaa

SEQ ID NO: 1827 - DNA, 20 bp, Artificial sequence
  Synthetic Oligonucleotide
tgtatctcttaacccagaga

SEQ ID NO: 1828 - DNA, 20 bp, Artificial sequence
  Synthetic Oligonucleotide
atgtatctcttaacccagag

SEQ ID NO: 1829 - DNA, 20 bp, Artificial sequence
  Synthetic Oligonucleotide
catgtatctcttaacccaga

SEQ ID NO: 1830 - DNA, 20 bp, Artificial sequence
  Synthetic Oligonucleotide
tcatgtatctcttaacccag

SEQ ID NO: 1831 - DNA, 20 bp, Artificial sequence
  Synthetic Oligonucleotide
tttcatgtatctcttaaccc

SEQ ID NO: 1832 - DNA, 20 bp, Artificial sequence
  Synthetic Oligonucleotide
ttttcatgtatctcttaacc

SEQ ID NO: 1833 - DNA, 20 bp, Artificial sequence
  Synthetic Oligonucleotide
gttttcatgtatctcttaac

SEQ ID NO: 1834 - DNA, 20 bp, Artificial sequence
  Synthetic Oligonucleotide
tgttttcatgtatctcttaa

SEQ ID NO: 1835 - DNA, 20 bp, Artificial sequence
  Synthetic Oligonucleotide
ctgttttcatgtatctctta

SEQ ID NO: 1836 - DNA, 20 bp, Artificial sequence
  Synthetic Oligonucleotide
aaattaacttggtctttttc

SEQ ID NO: 1837 - DNA, 20 bp, Artificial sequence
  Synthetic Oligonucleotide
tctgttgctcttagaatcta

SEQ ID NO: 1838 - DNA, 20 bp, Artificial sequence
  Synthetic Oligonucleotide
atggaaccttgaacttggga

SEQ ID NO: 1839 - DNA, 20 bp, Artificial sequence
  Synthetic Oligonucleotide
gattcagaaacacttttata

SEQ ID NO: 1840 - DNA, 20 bp, Artificial sequence
  Synthetic Oligonucleotide
aagttgctttgagaattttc

SEQ ID NO: 1841 - DNA, 20 bp, Artificial sequence
  Synthetic Oligonucleotide
aaatctagtccaacttcctc

SEQ ID NO: 1842 - DNA, 20 bp, Artificial sequence
  Synthetic Oligonucleotide
actcattggtaatggattat

SEQ ID NO: 1843 - DNA, 20 bp, Artificial sequence
  Synthetic Oligonucleotide
ttgcaatgtttcaatatgct

SEQ ID NO: 1844 - DNA, 20 bp, Artificial sequence
  Synthetic Oligonucleotide
attgcaatgtttcaatatgc

SEQ ID NO: 1845 - DNA, 20 bp, Artificial sequence
  Synthetic Oligonucleotide
gattgcaatgtttcaatatg

SEQ ID NO: 1846 - DNA, 20 bp, Artificial sequence
  Synthetic Oligonucleotide
tgattgcaatgtttcaatat

SEQ ID NO: 1847 - DNA, 20 bp, Artificial sequence
  Synthetic Oligonucleotide
ctgattgcaatgtttcaata

SEQ ID NO: 1848 - DNA, 20 bp, Artificial sequence
  Synthetic Oligonucleotide
tgctgattgcaatgtttcaa

SEQ ID NO: 1849 - DNA, 20 bp, Artificial sequence
  Synthetic Oligonucleotide
ttgctgattgcaatgtttca

SEQ ID NO: 1850 - DNA, 20 bp, Artificial sequence
  Synthetic Oligonucleotide
attgctgattgcaatgtttc

SEQ ID NO: 1851 - DNA, 20 bp, Artificial sequence
  Synthetic Oligonucleotide
aattgctgattgcaatgttt

SEQ ID NO: 1852 - DNA, 20 bp, Artificial sequence
  Synthetic Oligonucleotide
taattgctgattgcaatgtt

SEQ ID NO: 1853 - DNA, 20 bp, Artificial sequence
  Synthetic Oligonucleotide
aatcggaaatttaaattatc

SEQ ID NO: 1854 - DNA, 20 bp, Artificial sequence
  Synthetic Oligonucleotide
ttagtgacctaacagctcgg

SEQ ID NO: 1855 - DNA, 20 bp, Artificial sequence
  Synthetic Oligonucleotide
gtacagtatttattgaatca

SEQ ID NO: 1856 - DNA, 20 bp, Artificial sequence
  Synthetic Oligonucleotide
atttatgctatcatgtagtt

SEQ ID NO: 1857 - DNA, 20 bp, Artificial sequence
  Synthetic Oligonucleotide
aataatatattcccaggaaa

SEQ ID NO: 1858 - DNA, 20 bp, Artificial sequence
  Synthetic Oligonucleotide
tagcaaccatgtggcctaga

SEQ ID NO: 1859 - DNA, 20 bp, Artificial sequence
  Synthetic Oligonucleotide
actgtcaaaatctgaaagat

SEQ ID NO: 1860 - DNA, 20 bp, Artificial sequence
  Synthetic Oligonucleotide
agttagtttgacaattaaaa

SEQ ID NO: 1861 - DNA, 20 bp, Artificial sequence
  Synthetic Oligonucleotide
agtaactatacacataaagt

SEQ ID NO: 1862 - DNA, 20 bp, Artificial sequence
  Synthetic Oligonucleotide
caccggatttgctctttttt

SEQ ID NO: 1863 - DNA, 20 bp, Artificial sequence
  Synthetic Oligonucleotide
aatctactgcacacaacaca

SEQ ID NO: 1864 - DNA, 20 bp, Artificial sequence
  Synthetic Oligonucleotide
aatggagccattaattatta

SEQ ID NO: 1865 - DNA, 20 bp, Artificial sequence
  Synthetic Oligonucleotide
atttccttaccttttctaca

SEQ ID NO: 1866 - DNA, 20 bp, Artificial sequence
  Synthetic Oligonucleotide
gctttaaggtaaagtttttt

SEQ ID NO: 1867 - DNA, 20 bp, Artificial sequence
  Synthetic Oligonucleotide
gccagcattcaaaccctcaa

SEQ ID NO: 1868 - DNA, 20 bp, Artificial sequence
  Synthetic Oligonucleotide
atgagagtagattttaatag

SEQ ID NO: 1869 - DNA, 20 bp, Artificial sequence
  Synthetic Oligonucleotide
ctgagttccaaagcatttaa

SEQ ID NO: 1870 - DNA, 20 bp, Artificial sequence
  Synthetic Oligonucleotide
cacattttaatgcaggaaaa

SEQ ID NO: 1871 - DNA, 20 bp, Artificial sequence
  Synthetic Oligonucleotide
tggatataagtgaatacaca

SEQ ID NO: 1872 - DNA, 20 bp, Artificial sequence
  Synthetic Oligonucleotide
atagtggcccctaaatcctt

SEQ ID NO: 1873 - DNA, 20 bp, Artificial sequence
  Synthetic Oligonucleotide
tatagtggcccctaaatcct

SEQ ID NO: 1874 - DNA, 20 bp, Artificial sequence
  Synthetic Oligonucleotide
atatagtggcccctaaatcc

SEQ ID NO: 1875 - DNA, 20 bp, Artificial sequence
  Synthetic Oligonucleotide
catatagtggcccctaaatc

SEQ ID NO: 1876 - DNA, 20 bp, Artificial sequence
  Synthetic Oligonucleotide
tcatatagtggcccctaaat

SEQ ID NO: 1877 - DNA, 20 bp, Artificial sequence
  Synthetic Oligonucleotide
agtcatatagtggcccctaa

SEQ ID NO: 1878 - DNA, 20 bp, Artificial sequence
  Synthetic Oligonucleotide
tagtcatatagtggccccta

SEQ ID NO: 1879 - DNA, 20 bp, Artificial sequence
  Synthetic Oligonucleotide
atagtcatatagtggcccct

SEQ ID NO: 1880 - DNA, 20 bp, Artificial sequence
  Synthetic Oligonucleotide
catagtcatatagtggcccc

SEQ ID NO: 1881 - DNA, 20 bp, Artificial sequence
  Synthetic Oligonucleotide
ccatagtcatatagtggccc

SEQ ID NO: 1882 - DNA, 20 bp, Artificial sequence
  Synthetic Oligonucleotide
cttccaactcattctctctc

SEQ ID NO: 1883 - DNA, 20 bp, Artificial sequence
  Synthetic Oligonucleotide
gtggcctcagagctttctgc

SEQ ID NO: 1884 - DNA, 20 bp, Artificial sequence
  Synthetic Oligonucleotide
tccactgtgtagcctcattt

SEQ ID NO: 1885 - DNA, 20 bp, Artificial sequence
  Synthetic Oligonucleotide
aagccacatttattaccttt

SEQ ID NO: 1886 - DNA, 20 bp, Artificial sequence
  Synthetic Oligonucleotide
gagaaataacacaaaacttt

SEQ ID NO: 1887 - DNA, 20 bp, Artificial sequence
  Synthetic Oligonucleotide
ggcactgaaaagtcccaagt

SEQ ID NO: 1888 - DNA, 20 bp, Artificial sequence
  Synthetic Oligonucleotide
agtaggaaataggataagca

SEQ ID NO: 1889 - DNA, 20 bp, Artificial sequence
  Synthetic Oligonucleotide
ttaacatgtaaggactgaaa

SEQ ID NO: 1890 - DNA, 20 bp, Artificial sequence
  Synthetic Oligonucleotide
tgatgacatatccaccacat

SEQ ID NO: 1891 - DNA, 20 bp, Artificial sequence
  Synthetic Oligonucleotide
tttagcttactactatatat

SEQ ID NO: 1892 - DNA, 20 bp, Artificial sequence
  Synthetic Oligonucleotide
taatgcaagtaatacaaaaa

SEQ ID NO: 1893 - DNA, 20 bp, Artificial sequence
  Synthetic Oligonucleotide
ttctttaacaatcaatagag

SEQ ID NO: 1894 - DNA, 20 bp, Artificial sequence
  Synthetic Oligonucleotide
tatggatgaaaagtgaacat

SEQ ID NO: 1895 - DNA, 20 bp, Artificial sequence
  Synthetic Oligonucleotide
gaaattacctacacattaaa

SEQ ID NO: 1896 - DNA, 20 bp, Artificial sequence
  Synthetic Oligonucleotide
gacatttttaatgtactaat

SEQ ID NO: 1897 - DNA, 20 bp, Artificial sequence
  Synthetic Oligonucleotide
aattttctatcctggaaaag

SEQ ID NO: 1898 - DNA, 20 bp, Artificial sequence
  Synthetic Oligonucleotide
agaaggagttaagttagctc

SEQ ID NO: 1899 - DNA, 20 bp, Artificial sequence
  Synthetic Oligonucleotide
cagtgtagtcatactaacag

SEQ ID NO: 1900 - DNA, 20 bp, Artificial sequence
  Synthetic Oligonucleotide
acagtgtagtcatactaaca

SEQ ID NO: 1901 - DNA, 20 bp, Artificial sequence
  Synthetic Oligonucleotide
cacagtgtagtcatactaac

SEQ ID NO: 1902 - DNA, 20 bp, Artificial sequence
  Synthetic Oligonucleotide
acacagtgtagtcatactaa

SEQ ID NO: 1903 - DNA, 20 bp, Artificial sequence
  Synthetic Oligonucleotide
cacacagtgtagtcatacta

SEQ ID NO: 1904 - DNA, 20 bp, Artificial sequence
  Synthetic Oligonucleotide
tgcacacagtgtagtcatac

SEQ ID NO: 1905 - DNA, 20 bp, Artificial sequence
  Synthetic Oligonucleotide
gtgcacacagtgtagtcata

SEQ ID NO: 1906 - DNA, 20 bp, Artificial sequence
  Synthetic Oligonucleotide
agtgcacacagtgtagtcat

SEQ ID NO: 1907 - DNA, 20 bp, Artificial sequence
  Synthetic Oligonucleotide
cagtgcacacagtgtagtca

SEQ ID NO: 1908 - DNA, 20 bp, Artificial sequence
  Synthetic Oligonucleotide
acagtgcacacagtgtagtc

SEQ ID NO: 1909 - DNA, 20 bp, Artificial sequence
  Synthetic Oligonucleotide
cttgctttatggtaagaatg

SEQ ID NO: 1910 - DNA, 20 bp, Artificial sequence
  Synthetic Oligonucleotide
caagtctggatcacacttgt

SEQ ID NO: 1911 - DNA, 20 bp, Artificial sequence
  Synthetic Oligonucleotide
aaaatttgatcagggaaatg

SEQ ID NO: 1912 - DNA, 20 bp, Artificial sequence
  Synthetic Oligonucleotide
gtggaatagtgatgaatccc

SEQ ID NO: 1913 - DNA, 20 bp, Artificial sequence
  Synthetic Oligonucleotide
agactatttaaaaaatggga

SEQ ID NO: 1914 - DNA, 20 bp, Artificial sequence
  Synthetic Oligonucleotide
cacagtaattctgaaggctt

SEQ ID NO: 1915 - DNA, 20 bp, Artificial sequence
  Synthetic Oligonucleotide
ccttcccctactgtcaacac

SEQ ID NO: 1916 - DNA, 20 bp, Artificial sequence
  Synthetic Oligonucleotide
ccccaggcactgttttcctt

SEQ ID NO: 1917 - DNA, 20 bp, Artificial sequence
  Synthetic Oligonucleotide
gtttcagagaactagaataa

SEQ ID NO: 1918 - DNA, 20 bp, Artificial sequence
  Synthetic Oligonucleotide
acttcatcagaaactgctgg

SEQ ID NO: 1919 - DNA, 20 bp, Artificial sequence
  Synthetic Oligonucleotide
aaaattctgatttccaactc

SEQ ID NO: 1920 - DNA, 20 bp, Artificial sequence
  Synthetic Oligonucleotide
gtatgttaaataagaattga

SEQ ID NO: 1921 - DNA, 20 bp, Artificial sequence
  Synthetic Oligonucleotide
caatgtgatgcttgcatttt

SEQ ID NO: 1922 - DNA, 20 bp, Artificial sequence
  Synthetic Oligonucleotide
tgacaccaaattagtcattt

SEQ ID NO: 1923 - DNA, 20 bp, Artificial sequence
  Synthetic Oligonucleotide
tgtactcaaacatgtatata

SEQ ID NO: 1924 - DNA, 20 bp, Artificial sequence
  Synthetic Oligonucleotide
ggtcacggccagccccctgt

SEQ ID NO: 1925 - DNA, 20 bp, Artificial sequence
  Synthetic Oligonucleotide
aacatacactttgaagtgtt

SEQ ID NO: 1926 - DNA, 20 bp, Artificial sequence
  Synthetic Oligonucleotide
gtttaggagagactatagaa

SEQ ID NO: 1927 - DNA, 20 bp, Artificial sequence
  Synthetic Oligonucleotide
ggtttaggagagactataga

SEQ ID NO: 1928 - DNA, 20 bp, Artificial sequence
  Synthetic Oligonucleotide
tggtttaggagagactatag

SEQ ID NO: 1929 - DNA, 20 bp, Artificial sequence
  Synthetic Oligonucleotide
atggtttaggagagactata

SEQ ID NO: 1930 - DNA, 20 bp, Artificial sequence
  Synthetic Oligonucleotide
tatggtttaggagagactat

SEQ ID NO: 1931 - DNA, 20 bp, Artificial sequence
  Synthetic Oligonucleotide
catatggtttaggagagact

SEQ ID NO: 1932 - DNA, 20 bp, Artificial sequence
  Synthetic Oligonucleotide
gcatatggtttaggagagac

SEQ ID NO: 1933 - DNA, 20 bp, Artificial sequence
  Synthetic Oligonucleotide
tgcatatggtttaggagaga

SEQ ID NO: 1934 - DNA, 20 bp, Artificial sequence
  Synthetic Oligonucleotide
ttgcatatggtttaggagag

SEQ ID NO: 1935 - DNA, 20 bp, Artificial sequence
  Synthetic Oligonucleotide
gttgcatatggtttaggaga

SEQ ID NO: 1936 - DNA, 20 bp, Artificial sequence
  Synthetic Oligonucleotide
tctatggaatttcatccttt

SEQ ID NO: 1937 - DNA, 20 bp, Artificial sequence
  Synthetic Oligonucleotide
cagcaaaaccaggaagtcag

SEQ ID NO: 1938 - DNA, 20 bp, Artificial sequence
  Synthetic Oligonucleotide
gtattgttgccaaatgaatg

SEQ ID NO: 1939 - DNA, 20 bp, Artificial sequence
  Synthetic Oligonucleotide
tgtattgttgccaaatgaat

SEQ ID NO: 1940 - DNA, 20 bp, Artificial sequence
  Synthetic Oligonucleotide
atgtattgttgccaaatgaa

SEQ ID NO: 1941 - DNA, 20 bp, Artificial sequence
  Synthetic Oligonucleotide
aatgtattgttgccaaatga

SEQ ID NO: 1942 - DNA, 20 bp, Artificial sequence
  Synthetic Oligonucleotide
caatgtattgttgccaaatg

SEQ ID NO: 1943 - DNA, 20 bp, Artificial sequence
  Synthetic Oligonucleotide
ttcaatgtattgttgccaaa

SEQ ID NO: 1944 - DNA, 20 bp, Artificial sequence
  Synthetic Oligonucleotide
gttcaatgtattgttgccaa

SEQ ID NO: 1945 - DNA, 20 bp, Artificial sequence
  Synthetic Oligonucleotide
tgttcaatgtattgttgcca

SEQ ID NO: 1946 - DNA, 20 bp, Artificial sequence
  Synthetic Oligonucleotide
atgttcaatgtattgttgcc

SEQ ID NO: 1947 - DNA, 20 bp, Artificial sequence
  Synthetic Oligonucleotide
aatgttcaatgtattgttgc

SEQ ID NO: 1948 - DNA, 20 bp, Artificial sequence
  Synthetic Oligonucleotide
cacatccttttacaatagtt

SEQ ID NO: 1949 - DNA, 20 bp, Artificial sequence
  Synthetic Oligonucleotide
aggatggagacatcgaattt

SEQ ID NO: 1950 - DNA, 20 bp, Artificial sequence
  Synthetic Oligonucleotide
aaggatggagacatcgaatt

SEQ ID NO: 1951 - DNA, 20 bp, Artificial sequence
  Synthetic Oligonucleotide
gaaggatggagacatcgaat

SEQ ID NO: 1952 - DNA, 20 bp, Artificial sequence
  Synthetic Oligonucleotide
ggaaggatggagacatcgaa

SEQ ID NO: 1953 - DNA, 20 bp, Artificial sequence
  Synthetic Oligonucleotide
tggaaggatggagacatcga

SEQ ID NO: 1954 - DNA, 20 bp, Artificial sequence
  Synthetic Oligonucleotide
gttggaaggatggagacatc

SEQ ID NO: 1955 - DNA, 20 bp, Artificial sequence
  Synthetic Oligonucleotide
agttggaaggatggagacat

SEQ ID NO: 1956 - DNA, 20 bp, Artificial sequence
  Synthetic Oligonucleotide
gagttggaaggatggagaca

SEQ ID NO: 1957 - DNA, 20 bp, Artificial sequence
  Synthetic Oligonucleotide
agagttggaaggatggagac

SEQ ID NO: 1958 - DNA, 20 bp, Artificial sequence
  Synthetic Oligonucleotide
aagagttggaaggatggaga

SEQ ID NO: 1959 - DNA, 20 bp, Artificial sequence
  Synthetic Oligonucleotide
tggatagacagaaagttatc

SEQ ID NO: 1960 - DNA, 20 bp, Artificial sequence
  Synthetic Oligonucleotide
tccaggacagtgttttaaaa

SEQ ID NO: 1961 - DNA, 20 bp, Artificial sequence
  Synthetic Oligonucleotide
aatcttcattgtagagaaaa

SEQ ID NO: 1962 - DNA, 20 bp, Artificial sequence
  Synthetic Oligonucleotide
gcggattttttaaaaagcct

SEQ ID NO: 1963 - DNA, 20 bp, Artificial sequence
  Synthetic Oligonucleotide
taaaaagagacccaaataac

SEQ ID NO: 1964 - DNA, 20 bp, Artificial sequence
  Synthetic Oligonucleotide
tttaattctgtctctgtgtg

SEQ ID NO: 1965 - DNA, 20 bp, Artificial sequence
  Synthetic Oligonucleotide
gcttgagaagacctaagtaa

SEQ ID NO: 1966 - DNA, 20 bp, Artificial sequence
  Synthetic Oligonucleotide
gatggtaacctaaattaaaa

SEQ ID NO: 1967 - DNA, 20 bp, Artificial sequence
  Synthetic Oligonucleotide
agagctgtgacatggccacc

SEQ ID NO: 1968 - DNA, 20 bp, Artificial sequence
  Synthetic Oligonucleotide
tctctagattctgtttttga

SEQ ID NO: 1969 - DNA, 20 bp, Artificial sequence
  Synthetic Oligonucleotide
ctggaacccaactagatcac

SEQ ID NO: 1970 - DNA, 20 bp, Artificial sequence
  Synthetic Oligonucleotide
tgattctaaagcaaaacaca

SEQ ID NO: 1971 - DNA, 20 bp, Artificial sequence
  Synthetic Oligonucleotide
cttgcctggcagtgggaaaa

SEQ ID NO: 1972 - DNA, 20 bp, Artificial sequence
  Synthetic Oligonucleotide
aatgaaagactggctccctt

SEQ ID NO: 1973 - DNA, 20 bp, Artificial sequence
  Synthetic Oligonucleotide
gttcagagatgtgctattta

SEQ ID NO: 1974 - DNA, 20 bp, Artificial sequence
  Synthetic Oligonucleotide
gcacaatatttatcttcagg

SEQ ID NO: 1975 - DNA, 20 bp, Artificial sequence
  Synthetic Oligonucleotide
taatgttgaggcacaatatt

SEQ ID NO: 1976 - DNA, 20 bp, Artificial sequence
  Synthetic Oligonucleotide
aaagatctgtaatttcccca

SEQ ID NO: 1977 - DNA, 20 bp, Artificial sequence
  Synthetic Oligonucleotide
agcaatacaaatacagcata

SEQ ID NO: 1978 - DNA, 20 bp, Artificial sequence
  Synthetic Oligonucleotide
gtaggtagaccaatgtagag

SEQ ID NO: 1979 - DNA, 20 bp, Artificial sequence
  Synthetic Oligonucleotide
attaataaaatacctaggag

SEQ ID NO: 1980 - DNA, 20 bp, Artificial sequence
  Synthetic Oligonucleotide
tactaagattacaatgagtt

SEQ ID NO: 1981 - DNA, 20 bp, Artificial sequence
  Synthetic Oligonucleotide
ttcctacaatcaatacttaa

SEQ ID NO: 1982 - DNA, 20 bp, Artificial sequence
  Synthetic Oligonucleotide
gaactatgatttatgctctt

SEQ ID NO: 1983 - DNA, 20 bp, Artificial sequence
  Synthetic Oligonucleotide
attgcatcagattgatgtac

SEQ ID NO: 1984 - DNA, 20 bp, Artificial sequence
  Synthetic Oligonucleotide
aaaaatcctcattcatggga

SEQ ID NO: 1985 - DNA, 20 bp, Artificial sequence
  Synthetic Oligonucleotide
taaagcatctatgctccaaa

SEQ ID NO: 1986 - DNA, 20 bp, Artificial sequence
  Synthetic Oligonucleotide
gcagacctagaactccaaaa

SEQ ID NO: 1987 - DNA, 20 bp, Artificial sequence
  Synthetic Oligonucleotide
aacaacgaggaatatgtaaa

SEQ ID NO: 1988 - DNA, 20 bp, Artificial sequence
  Synthetic Oligonucleotide
caaaatagaccaaccagtcc

SEQ ID NO: 1989 - DNA, 20 bp, Artificial sequence
  Synthetic Oligonucleotide
catccaaacataaacagaaa

SEQ ID NO: 1990 - DNA, 20 bp, Artificial sequence
  Synthetic Oligonucleotide
gttagccttttatacctaga

SEQ ID NO: 1991 - DNA, 20 bp, Artificial sequence
  Synthetic Oligonucleotide
atctgtaacttttgaatgtt

SEQ ID NO: 1992 - DNA, 20 bp, Artificial sequence
  Synthetic Oligonucleotide
ggtcttgatccccactcctt

SEQ ID NO: 1993 - DNA, 20 bp, Artificial sequence
  Synthetic Oligonucleotide
tatcaaggagacctgttggc

SEQ ID NO: 1994 - DNA, 20 bp, Artificial sequence
  Synthetic Oligonucleotide
aagttttacatgaagtctca

SEQ ID NO: 1995 - DNA, 20 bp, Artificial sequence
  Synthetic Oligonucleotide
agctgttatgggaacccaaa

SEQ ID NO: 1996 - DNA, 20 bp, Artificial sequence
  Synthetic Oligonucleotide
cgtccgctgctcagggaacc

SEQ ID NO: 1997 - DNA, 20 bp, Artificial sequence
  Synthetic Oligonucleotide
aacgcacttaacaatatcat

SEQ ID NO: 1998 - DNA, 20 bp, Artificial sequence
  Synthetic Oligonucleotide
atagcttccaccacaatatt

SEQ ID NO: 1999 - DNA, 20 bp, Artificial sequence
  Synthetic Oligonucleotide
tttgatgaagaatgcatcag

SEQ ID NO: 2000 - DNA, 20 bp, Artificial sequence
  Synthetic Oligonucleotide
cactttcagccacttcagga

SEQ ID NO: 2001 - DNA, 20 bp, Artificial sequence
  Synthetic Oligonucleotide
aatatcattcttgaaacact

SEQ ID NO: 2002 - DNA, 20 bp, Artificial sequence
  Synthetic Oligonucleotide
atccagggccagcctcctta

SEQ ID NO: 2003 - DNA, 20 bp, Artificial sequence
  Synthetic Oligonucleotide
tgaagctccagcttttcaag

SEQ ID NO: 2004 - DNA, 20 bp, Artificial sequence
  Synthetic Oligonucleotide
tctccactttaggacaagcc

SEQ ID NO: 2005 - DNA, 20 bp, Artificial sequence
  Synthetic Oligonucleotide
gatgcagtttctctactcta

SEQ ID NO: 2006 - DNA, 20 bp, Artificial sequence
  Synthetic Oligonucleotide
ggatgagtactatagaattc

SEQ ID NO: 2007 - DNA, 20 bp, Artificial sequence
  Synthetic Oligonucleotide
ttccggtcaattacgggaaa

SEQ ID NO: 2008 - DNA, 20 bp, Artificial sequence
  Synthetic Oligonucleotide
atctggaatttttctaggag

SEQ ID NO: 2009 - DNA, 20 bp, Artificial sequence
  Synthetic Oligonucleotide
caggaaaccattcttccatg

SEQ ID NO: 2010 - DNA, 20 bp, Artificial sequence
  Synthetic Oligonucleotide
gtttattaaaaatcttcaca

SEQ ID NO: 2011 - DNA, 20 bp, Artificial sequence
  Synthetic Oligonucleotide
aatgcttgcattcctgctgt

SEQ ID NO: 2012 - DNA, 20 bp, Artificial sequence
  Synthetic Oligonucleotide
tccacaacagggctattttg

SEQ ID NO: 2013 - DNA, 20 bp, Artificial sequence
  Synthetic Oligonucleotide
aattcatttgaatatttaca

SEQ ID NO: 2014 - DNA, 20 bp, Artificial sequence
  Synthetic Oligonucleotide
gttaaagcatagcttccttt

SEQ ID NO: 2015 - DNA, 20 bp, Artificial sequence
  Synthetic Oligonucleotide
aatgaaggtggccagaatca

SEQ ID NO: 2016 - DNA, 20 bp, Artificial sequence
  Synthetic Oligonucleotide
aagtgagtattaaaatgtca

SEQ ID NO: 2017 - DNA, 20 bp, Artificial sequence
  Synthetic Oligonucleotide
caaaatgtaagttatcagaa

SEQ ID NO: 2018 - DNA, 20 bp, Artificial sequence
  Synthetic Oligonucleotide
tcaataatgtttagttagtt

SEQ ID NO: 2019 - DNA, 20 bp, Artificial sequence
  Synthetic Oligonucleotide
actatagtacatgtatctca

SEQ ID NO: 2020 - DNA, 20 bp, Artificial sequence
  Synthetic Oligonucleotide
ttatacatgacagcctgaag

SEQ ID NO: 2021 - DNA, 20 bp, Artificial sequence
  Synthetic Oligonucleotide
agaacacttattacatacca

SEQ ID NO: 2022 - DNA, 20 bp, Artificial sequence
  Synthetic Oligonucleotide
tttttgacactccttttaaa

SEQ ID NO: 2023 - DNA, 20 bp, Artificial sequence
  Synthetic Oligonucleotide
acgatcattccttattattc

SEQ ID NO: 2024 - DNA, 20 bp, Artificial sequence
  Synthetic Oligonucleotide
ggcacgacaatattcattgt

SEQ ID NO: 2025 - DNA, 20 bp, Artificial sequence
  Synthetic Oligonucleotide
caacctgctggctagtcacc

SEQ ID NO: 2026 - DNA, 20 bp, Artificial sequence
  Synthetic Oligonucleotide
taattatacaaagctataag

SEQ ID NO: 2027 - DNA, 20 bp, Artificial sequence
  Synthetic Oligonucleotide
atagaacattttacacacta

SEQ ID NO: 2028 - DNA, 20 bp, Artificial sequence
  Synthetic Oligonucleotide
aaccgccagctatataatct

SEQ ID NO: 2029 - DNA, 20 bp, Artificial sequence
  Synthetic Oligonucleotide
aggtgataacagatgtcagt

SEQ ID NO: 2030 - DNA, 20 bp, Artificial sequence
  Synthetic Oligonucleotide
agtaatagattgaaagaaac

SEQ ID NO: 2031 - DNA, 20 bp, Artificial sequence
  Synthetic Oligonucleotide
ttaatagtataaatacagaa

SEQ ID NO: 2032 - DNA, 20 bp, Artificial sequence
  Synthetic Oligonucleotide
ccgactgctgaggttacacc

SEQ ID NO: 2033 - DNA, 20 bp, Artificial sequence
  Synthetic Oligonucleotide
gtgagggagaggacataaag

SEQ ID NO: 2034 - DNA, 20 bp, Artificial sequence
  Synthetic Oligonucleotide
tgtattacataggtatgact

SEQ ID NO: 2035 - DNA, 20 bp, Artificial sequence
  Synthetic Oligonucleotide
ctttaaagatgcagaaataa

SEQ ID NO: 2036 - DNA, 20 bp, Artificial sequence
  Synthetic Oligonucleotide
ttacccgtgcatgcacctgt

SEQ ID NO: 2037 - DNA, 20 bp, Artificial sequence
  Synthetic Oligonucleotide
atattaaatacagtaaggtt

SEQ ID NO: 2038 - DNA, 20 bp, Artificial sequence
  Synthetic Oligonucleotide
ccattcactccttactttgt

SEQ ID NO: 2039 - DNA, 20 bp, Artificial sequence
  Synthetic Oligonucleotide
aaagataaaaatagtgtcag

SEQ ID NO: 2040 - DNA, 20 bp, Artificial sequence
  Synthetic Oligonucleotide
ctcaagtttttccagatgat

SEQ ID NO: 2041 - DNA, 20 bp, Artificial sequence
  Synthetic Oligonucleotide
aggtttcttaagtgggatac

SEQ ID NO: 2042 - DNA, 20 bp, Artificial sequence
  Synthetic Oligonucleotide
gcttagagacaaattaaggg

SEQ ID NO: 2043 - DNA, 20 bp, Artificial sequence
  Synthetic Oligonucleotide
ttatatataaattcgaaaga

SEQ ID NO: 2044 - DNA, 20 bp, Artificial sequence
  Synthetic Oligonucleotide
tcagatctgtttccattgcc

SEQ ID NO: 2045 - DNA, 20 bp, Artificial sequence
  Synthetic Oligonucleotide
caatttctaattttataatg

SEQ ID NO: 2046 - DNA, 20 bp, Artificial sequence
  Synthetic Oligonucleotide
atttcctctattatttcata

SEQ ID NO: 2047 - DNA, 20 bp, Artificial sequence
  Synthetic Oligonucleotide
aatacagtatacaggccagt

SEQ ID NO: 2048 - DNA, 20 bp, Artificial sequence
  Synthetic Oligonucleotide
cattacctttcttgatttat

SEQ ID NO: 2049 - DNA, 20 bp, Artificial sequence
  Synthetic Oligonucleotide
tttcctttcccatcttcatg

SEQ ID NO: 2050 - DNA, 20 bp, Artificial sequence
  Synthetic Oligonucleotide
gaggacaaaaaatgatctct

SEQ ID NO: 2051 - DNA, 20 bp, Artificial sequence
  Synthetic Oligonucleotide
ctaaatttgttttcttatga

SEQ ID NO: 2052 - DNA, 20 bp, Artificial sequence
  Synthetic Oligonucleotide
accagggaggcaatatagaa

SEQ ID NO: 2053 - DNA, 20 bp, Artificial sequence
  Synthetic Oligonucleotide
ccacatggagaagcaccaat

SEQ ID NO: 2054 - DNA, 20 bp, Artificial sequence
  Synthetic Oligonucleotide
aaagtcaatgaaggtaatca

SEQ ID NO: 2055 - DNA, 20 bp, Artificial sequence
  Synthetic Oligonucleotide
attaaggcaaatacaaagat

SEQ ID NO: 2056 - DNA, 20 bp, Artificial sequence
  Synthetic Oligonucleotide
gctgcattaatatggagtat

SEQ ID NO: 2057 - DNA, 20 bp, Artificial sequence
  Synthetic Oligonucleotide
tgcccttccaactcaatcac

SEQ ID NO: 2058 - DNA, 20 bp, Artificial sequence
  Synthetic Oligonucleotide
ttatagataaaacttgaaga

SEQ ID NO: 2059 - DNA, 20 bp, Artificial sequence
  Synthetic Oligonucleotide
atgctttaaactgtgattgc

SEQ ID NO: 2060 - DNA, 20 bp, Artificial sequence
  Synthetic Oligonucleotide
ttaagatgatgggttctaga

SEQ ID NO: 2061 - DNA, 20 bp, Artificial sequence
  Synthetic Oligonucleotide
tgcaagaaacacaagttgga

SEQ ID NO: 2062 - DNA, 20 bp, Artificial sequence
  Synthetic Oligonucleotide
atgcacaggaaatcttattc

SEQ ID NO: 2063 - DNA, 20 bp, Artificial sequence
  Synthetic Oligonucleotide
atattggagattaaaaggga

SEQ ID NO: 2064 - DNA, 20 bp, Artificial sequence
  Synthetic Oligonucleotide
tttacaaacgacataatcct

SEQ ID NO: 2065 - DNA, 20 bp, Artificial sequence
  Synthetic Oligonucleotide
agacccaaataacgatttaa

SEQ ID NO: 2066 - DNA, 20 bp, Artificial sequence
  Synthetic Oligonucleotide
ccaaatcaagagctcacaac

SEQ ID NO: 2067 - DNA, 20 bp, Artificial sequence
  Synthetic Oligonucleotide
tagtactttttttccaatac

SEQ ID NO: 2068 - DNA, 20 bp, Artificial sequence
  Synthetic Oligonucleotide
agatattcatgctcacagac

SEQ ID NO: 2069 - DNA, 20 bp, Artificial sequence
  Synthetic Oligonucleotide
tgttgtcagagagccactac

SEQ ID NO: 2070 - DNA, 20 bp, Artificial sequence
  Synthetic Oligonucleotide
gaagcattacaaattttttt

SEQ ID NO: 2071 - DNA, 20 bp, Artificial sequence
  Synthetic Oligonucleotide
ccaaagtacatacaattcaa

SEQ ID NO: 2072 - DNA, 20 bp, Artificial sequence
  Synthetic Oligonucleotide
tttccttcctggacattgtt

SEQ ID NO: 2073 - DNA, 20 bp, Artificial sequence
  Synthetic Oligonucleotide
taacgcacttaacaatatca

SEQ ID NO: 2074 - DNA, 20 bp, Artificial sequence
  Synthetic Oligonucleotide
tcatagcttccaccacaata

SEQ ID NO: 2075 - DNA, 20 bp, Artificial sequence
  Synthetic Oligonucleotide
cttcctttgatgaagaatgc

SEQ ID NO: 2076 - DNA, 20 bp, Artificial sequence
  Synthetic Oligonucleotide
ccactttcagccacttcagg

SEQ ID NO: 2077 - DNA, 20 bp, Artificial sequence
  Synthetic Oligonucleotide
gaatccatagcaccttccag

SEQ ID NO: 2078 - DNA, 20 bp, Artificial sequence
  Synthetic Oligonucleotide
tatacaaaatcctccaaggc

SEQ ID NO: 2079 - DNA, 20 bp, Artificial sequence
  Synthetic Oligonucleotide
ttcacatagctgttgtggaa

SEQ ID NO: 2080 - DNA, 20 bp, Artificial sequence
  Synthetic Oligonucleotide
gaaactctccactttaggac

SEQ ID NO: 2081 - DNA, 20 bp, Artificial sequence
  Synthetic Oligonucleotide
gggatgagtactatagaatt

SEQ ID NO: 2082 - DNA, 20 bp, Artificial sequence
  Synthetic Oligonucleotide
tttccggtcaattacgggaa

SEQ ID NO: 2083 - DNA, 20 bp, Artificial sequence
  Synthetic Oligonucleotide
caatctggaatttttctagg

SEQ ID NO: 2084 - DNA, 20 bp, Artificial sequence
  Synthetic Oligonucleotide
agagtttctccttcaccaca

SEQ ID NO: 2085 - DNA, 20 bp, Artificial sequence
  Synthetic Oligonucleotide
aaagcaccacaagctcttgt

SEQ ID NO: 2086 - DNA, 20 bp, Artificial sequence
  Synthetic Oligonucleotide
caaatgcttgcattcctgct

SEQ ID NO: 2087 - DNA, 20 bp, Artificial sequence
  Synthetic Oligonucleotide
tattagtccacagagttttt

SEQ ID NO: 2088 - DNA, 20 bp, Artificial sequence
  Synthetic Oligonucleotide
gaagttgtgtaagatgcact

SEQ ID NO: 2089 - DNA, 20 bp, Artificial sequence
  Synthetic Oligonucleotide
gagctctattatatatgatt

SEQ ID NO: 2090 - DNA, 20 bp, Artificial sequence
  Synthetic Oligonucleotide
ttatctagaccctgcagacc

SEQ ID NO: 2091 - DNA, 20 bp, Artificial sequence
  Synthetic Oligonucleotide
gaaggaaaaatactactttt

SEQ ID NO: 2092 - DNA, 20 bp, Artificial sequence
  Synthetic Oligonucleotide
agttttagaggttgtaccaa

SEQ ID NO: 2093 - DNA, 20 bp, Artificial sequence
  Synthetic Oligonucleotide
gtagtgggccggtggccgtt

SEQ ID NO: 2094 - DNA, 20 bp, Artificial sequence
  Synthetic Oligonucleotide
gcttaattgctctacagtcc

SEQ ID NO: 2095 - DNA, 20 bp, Artificial sequence
  Synthetic Oligonucleotide
atcctaattgtcatcgaaag

SEQ ID NO: 2096 - DNA, 20 bp, Artificial sequence
  Synthetic Oligonucleotide
ataaaatacatattgtctaa

SEQ ID NO: 2097 - DNA, 20 bp, Artificial sequence
  Synthetic Oligonucleotide
tatagaactacatctataaa

SEQ ID NO: 2098 - DNA, 20 bp, Artificial sequence
  Synthetic Oligonucleotide
tacaagttgctacaatggag

SEQ ID NO: 2099 - DNA, 20 bp, Artificial sequence
  Synthetic Oligonucleotide
atgtcatgtctgtgacacac

SEQ ID NO: 2100 - DNA, 20 bp, Artificial sequence
  Synthetic Oligonucleotide
ttatgatgtttgaatggcac

SEQ ID NO: 2101 - DNA, 20 bp, Artificial sequence
  Synthetic Oligonucleotide
attttttgccctctaaaaat

SEQ ID NO: 2102 - DNA, 20 bp, Artificial sequence
  Synthetic Oligonucleotide
cccagcaaatgctgctggtc

SEQ ID NO: 2103 - DNA, 20 bp, Artificial sequence
  Synthetic Oligonucleotide
tgtgccaattatttttttta

SEQ ID NO: 2104 - DNA, 20 bp, Artificial sequence
  Synthetic Oligonucleotide
aatacagacataggtgtttt

SEQ ID NO: 2105 - DNA, 20 bp, Artificial sequence
  Synthetic Oligonucleotide
ttcttaaagaatttcacatt

SEQ ID NO: 2106 - DNA, 20 bp, Artificial sequence
  Synthetic Oligonucleotide
tttcacttcccacatcccca

SEQ ID NO: 2107 - DNA, 20 bp, Artificial sequence
  Synthetic Oligonucleotide
cacagcacttacttgctctc

SEQ ID NO: 2108 - DNA, 20 bp, Artificial sequence
  Synthetic Oligonucleotide
aattccaggaaccacaaact

SEQ ID NO: 2109 - DNA, 20 bp, Artificial sequence
  Synthetic Oligonucleotide
tcagtacaggttaatgatga

SEQ ID NO: 2110 - DNA, 20 bp, Artificial sequence
  Synthetic Oligonucleotide
cagcttcatgtaataggttt

SEQ ID NO: 2111 - DNA, 20 bp, Artificial sequence
  Synthetic Oligonucleotide
cctctaatattacatattaa

SEQ ID NO: 2112 - DNA, 20 bp, Artificial sequence
  Synthetic Oligonucleotide
aatccataggcaagtgggat

SEQ ID NO: 2113 - DNA, 20 bp, Artificial sequence
  Synthetic Oligonucleotide
accatttctcctcccggctc

SEQ ID NO: 2114 - DNA, 20 bp, Artificial sequence
  Synthetic Oligonucleotide
aaaagataaaaatagtgtca

SEQ ID NO: 2115 - DNA, 20 bp, Artificial sequence
  Synthetic Oligonucleotide
ttccttgacccatcacttta

SEQ ID NO: 2116 - DNA, 20 bp, Artificial sequence
  Synthetic Oligonucleotide
aaggtttcttaagtgggata

SEQ ID NO: 2117 - DNA, 20 bp, Artificial sequence
  Synthetic Oligonucleotide
tggccttctgcttagagaca

SEQ ID NO: 2118 - DNA, 20 bp, Artificial sequence
  Synthetic Oligonucleotide
actactttttataactaaat

SEQ ID NO: 2119 - DNA, 20 bp, Artificial sequence
  Synthetic Oligonucleotide
atcagatctgtttccattgc

SEQ ID NO: 2120 - DNA, 20 bp, Artificial sequence
  Synthetic Oligonucleotide
tttgaattaatgatttaaca

SEQ ID NO: 2121 - DNA, 20 bp, Artificial sequence
  Synthetic Oligonucleotide
gaattcctgtttattgtcat

SEQ ID NO: 2122 - DNA, 20 bp, Artificial sequence
  Synthetic Oligonucleotide
agctgaaaaacaagtaatac

SEQ ID NO: 2123 - DNA, 20 bp, Artificial sequence
  Synthetic Oligonucleotide
aattagagaaaaagactaaa

SEQ ID NO: 2124 - DNA, 20 bp, Artificial sequence
  Synthetic Oligonucleotide
aagaaaagaacaactgtcct

SEQ ID NO: 2125 - DNA, 20 bp, Artificial sequence
  Synthetic Oligonucleotide
agaggacaaaaaatgatctc

SEQ ID NO: 2126 - DNA, 20 bp, Artificial sequence
  Synthetic Oligonucleotide
acattatgaatgtcatttga

SEQ ID NO: 2127 - DNA, 20 bp, Artificial sequence
  Synthetic Oligonucleotide
tcctgattaacattctttaa

SEQ ID NO: 2128 - DNA, 20 bp, Artificial sequence
  Synthetic Oligonucleotide
atctgcttcatttctcttgg

SEQ ID NO: 2129 - DNA, 20 bp, Artificial sequence
  Synthetic Oligonucleotide
gcaaatgattttactgctta

SEQ ID NO: 2130 - DNA, 20 bp, Artificial sequence
  Synthetic Oligonucleotide
cttatttgcctcccatatcc

SEQ ID NO: 2131 - DNA, 20 bp, Artificial sequence
  Synthetic Oligonucleotide
tttttaaagcccttctctat

SEQ ID NO: 2132 - DNA, 20 bp, Artificial sequence
  Synthetic Oligonucleotide
ctacacttccaactttgtgt

SEQ ID NO: 2133 - DNA, 20 bp, Artificial sequence
  Synthetic Oligonucleotide
gaaacctgtaagagacagtc

SEQ ID NO: 2134 - DNA, 20 bp, Artificial sequence
  Synthetic Oligonucleotide
gtgtgatgttaaattgattc

SEQ ID NO: 2135 - DNA, 20 bp, Artificial sequence
  Synthetic Oligonucleotide
catttttatagaaggcagat

SEQ ID NO: 2136 - DNA, 20 bp, Artificial sequence
  Synthetic Oligonucleotide
actctcctactagactgtaa

SEQ ID NO: 2137 - DNA, 20 bp, Artificial sequence
  Synthetic Oligonucleotide
attctcttctttttattcag

SEQ ID NO: 2138 - DNA, 20 bp, Artificial sequence
  Synthetic Oligonucleotide
attaggccctgggtttctga

SEQ ID NO: 2139 - DNA, 20 bp, Artificial sequence
  Synthetic Oligonucleotide
aagataaaacatatccctaa

SEQ ID NO: 2140 - DNA, 20 bp, Artificial sequence
  Synthetic Oligonucleotide
tttatgtaaatttacttgtc

SEQ ID NO: 2141 - DNA, 20 bp, Artificial sequence
  Synthetic Oligonucleotide
taaagtcattatagttgtac

SEQ ID NO: 2142 - DNA, 20 bp, Artificial sequence
  Synthetic Oligonucleotide
aaaaaacaggcttcacattt

SEQ ID NO: 2143 - DNA, 20 bp, Artificial sequence
  Synthetic Oligonucleotide
atctctataaggaaacctga

SEQ ID NO: 2144 - DNA, 20 bp, Artificial sequence
  Synthetic Oligonucleotide
tttaacaatcattagtatat

SEQ ID NO: 2145 - DNA, 20 bp, Artificial sequence
  Synthetic Oligonucleotide
gagaacattctttgtaatac

SEQ ID NO: 2146 - DNA, 20 bp, Artificial sequence
  Synthetic Oligonucleotide
tgagaagaactggatgttca

SEQ ID NO: 2147 - DNA, 20 bp, Artificial sequence
  Synthetic Oligonucleotide
agacgatcaacagaggcaca

SEQ ID NO: 2148 - DNA, 20 bp, Artificial sequence
  Synthetic Oligonucleotide
gttaacgcacttaacaatat

SEQ ID NO: 2149 - DNA, 20 bp, Artificial sequence
  Synthetic Oligonucleotide
ttcatagcttccaccacaat

SEQ ID NO: 2150 - DNA, 20 bp, Artificial sequence
  Synthetic Oligonucleotide
tttctgaaattaacattttg

SEQ ID NO: 2151 - DNA, 20 bp, Artificial sequence
  Synthetic Oligonucleotide
agccactttcagccacttca

SEQ ID NO: 2152 - DNA, 20 bp, Artificial sequence
  Synthetic Oligonucleotide
ctgaatccatagcaccttcc

SEQ ID NO: 2153 - DNA, 20 bp, Artificial sequence
  Synthetic Oligonucleotide
tttcctatacaaaatcctcc

SEQ ID NO: 2154 - DNA, 20 bp, Artificial sequence
  Synthetic Oligonucleotide
aaactcttcagagtttcaca

SEQ ID NO: 2155 - DNA, 20 bp, Artificial sequence
  Synthetic Oligonucleotide
caagaaaggcatagcagcaa

SEQ ID NO: 2156 - DNA, 20 bp, Artificial sequence
  Synthetic Oligonucleotide
aagatgcagtttctctactc

SEQ ID NO: 2157 - DNA, 20 bp, Artificial sequence
  Synthetic Oligonucleotide
ttcagcctgtcccttgctga

SEQ ID NO: 2158 - DNA, 20 bp, Artificial sequence
  Synthetic Oligonucleotide
cgtttccggtcaattacggg

SEQ ID NO: 2159 - DNA, 20 bp, Artificial sequence
  Synthetic Oligonucleotide
gggaagctctatcacaggcc

SEQ ID NO: 2160 - DNA, 20 bp, Artificial sequence
  Synthetic Oligonucleotide
tataatgcccatttcttcaa

SEQ ID NO: 2161 - DNA, 20 bp, Artificial sequence
  Synthetic Oligonucleotide
gtggcaaagcaccacaagct

SEQ ID NO: 2162 - DNA, 20 bp, Artificial sequence
  Synthetic Oligonucleotide
ccaaatgcttgcattcctgc

SEQ ID NO: 2163 - DNA, 20 bp, Artificial sequence
  Synthetic Oligonucleotide
ttttgtgttttgattccttg

SEQ ID NO: 2164 - DNA, 20 bp, Artificial sequence
  Synthetic Oligonucleotide
tttcattagtacttttaatg

SEQ ID NO: 2165 - DNA, 20 bp, Artificial sequence
  Synthetic Oligonucleotide
aaattgcaaatacaaagtaa

SEQ ID NO: 2166 - DNA, 20 bp, Artificial sequence
  Synthetic Oligonucleotide
ctgggttgtcaagtatagca

SEQ ID NO: 2167 - DNA, 20 bp, Artificial sequence
  Synthetic Oligonucleotide
tatcatgttaaatggcatct

SEQ ID NO: 2168 - DNA, 20 bp, Artificial sequence
  Synthetic Oligonucleotide
catataatttctaaattatg

SEQ ID NO: 2169 - DNA, 20 bp, Artificial sequence
  Synthetic Oligonucleotide
gttgatatattaaaatatag

SEQ ID NO: 2170 - DNA, 20 bp, Artificial sequence
  Synthetic Oligonucleotide
attctcatctagaatgcaaa

SEQ ID NO: 2171 - DNA, 20 bp, Artificial sequence
  Synthetic Oligonucleotide
tactctacatttatagtcat

SEQ ID NO: 2172 - DNA, 20 bp, Artificial sequence
  Synthetic Oligonucleotide
gaaggctcacaccttcagat

SEQ ID NO: 2173 - DNA, 20 bp, Artificial sequence
  Synthetic Oligonucleotide
tatacaacatttaagttgga

SEQ ID NO: 2174 - DNA, 20 bp, Artificial sequence
  Synthetic Oligonucleotide
catctgtgtataaatatgta

SEQ ID NO: 2175 - DNA, 20 bp, Artificial sequence
  Synthetic Oligonucleotide
ctgattccctctcatgtcat

SEQ ID NO: 2176 - DNA, 20 bp, Artificial sequence
  Synthetic Oligonucleotide
actccttgctacagcttgta

SEQ ID NO: 2177 - DNA, 20 bp, Artificial sequence
  Synthetic Oligonucleotide
ggtgagatgaaaaaggagga

SEQ ID NO: 2178 - DNA, 20 bp, Artificial sequence
  Synthetic Oligonucleotide
ctgtttatcaagttccccca

SEQ ID NO: 2179 - DNA, 20 bp, Artificial sequence
  Synthetic Oligonucleotide
gttttcactgcaacttctgt

SEQ ID NO: 2180 - DNA, 20 bp, Artificial sequence
  Synthetic Oligonucleotide
taaatgtgttggatgaatac

SEQ ID NO: 2181 - DNA, 20 bp, Artificial sequence
  Synthetic Oligonucleotide
tagagtttcatatccctttg

SEQ ID NO: 2182 - DNA, 20 bp, Artificial sequence
  Synthetic Oligonucleotide
gagtggatttatgttactgg

SEQ ID NO: 2183 - DNA, 20 bp, Artificial sequence
  Synthetic Oligonucleotide
ccacatcacagcacttactt

SEQ ID NO: 2184 - DNA, 20 bp, Artificial sequence
  Synthetic Oligonucleotide
catagtctgtaggtagtagt

SEQ ID NO: 2185 - DNA, 20 bp, Artificial sequence
  Synthetic Oligonucleotide
cgttaataattttcaaacaa

SEQ ID NO: 2186 - DNA, 20 bp, Artificial sequence
  Synthetic Oligonucleotide
cttgaccagtaaaacgcaat

SEQ ID NO: 2187 - DNA, 20 bp, Artificial sequence
  Synthetic Oligonucleotide
cagagtctgtcctcttcact

SEQ ID NO: 2188 - DNA, 20 bp, Artificial sequence
  Synthetic Oligonucleotide
gtttatgtgattttaattca

SEQ ID NO: 2189 - DNA, 20 bp, Artificial sequence
  Synthetic Oligonucleotide
aagcactacagagctctgat

SEQ ID NO: 2190 - DNA, 20 bp, Artificial sequence
  Synthetic Oligonucleotide
ctgaccaaaactggtgtttt

SEQ ID NO: 2191 - DNA, 20 bp, Artificial sequence
  Synthetic Oligonucleotide
tttcctggaatattaaccat

SEQ ID NO: 2192 - DNA, 20 bp, Artificial sequence
  Synthetic Oligonucleotide
aaaaggtttcttaagtggga

SEQ ID NO: 2193 - DNA, 20 bp, Artificial sequence
  Synthetic Oligonucleotide
ctggccttctgcttagagac

SEQ ID NO: 2194 - DNA, 20 bp, Artificial sequence
  Synthetic Oligonucleotide
atataatttctcattaacca

SEQ ID NO: 2195 - DNA, 20 bp, Artificial sequence
  Synthetic Oligonucleotide
taatcagatctgtttccatt

SEQ ID NO: 2196 - DNA, 20 bp, Artificial sequence
  Synthetic Oligonucleotide
tatttgaattaatgatttaa

SEQ ID NO: 2197 - DNA, 20 bp, Artificial sequence
  Synthetic Oligonucleotide
tattctctatgaaggaagat

SEQ ID NO: 2198 - DNA, 20 bp, Artificial sequence
  Synthetic Oligonucleotide
gacaaacaaattatcaattt

SEQ ID NO: 2199 - DNA, 20 bp, Artificial sequence
  Synthetic Oligonucleotide
tcttttacatgtcacactat

SEQ ID NO: 2200 - DNA, 20 bp, Artificial sequence
  Synthetic Oligonucleotide
tgttgatatttgctttccgt

SEQ ID NO: 2201 - DNA, 20 bp, Artificial sequence
  Synthetic Oligonucleotide
tgaaaaataaatgagaggac

SEQ ID NO: 2202 - DNA, 20 bp, Artificial sequence
  Synthetic Oligonucleotide
gagaattttcatctttgaga

SEQ ID NO: 2203 - DNA, 20 bp, Artificial sequence
  Synthetic Oligonucleotide
ttatttgtccccatacatga

SEQ ID NO: 2204 - DNA, 20 bp, Artificial sequence
  Synthetic Oligonucleotide
gtagcagaattaatattttt

SEQ ID NO: 2205 - DNA, 20 bp, Artificial sequence
  Synthetic Oligonucleotide
ccaaccttgttgagcaaatg

SEQ ID NO: 2206 - DNA, 20 bp, Artificial sequence
  Synthetic Oligonucleotide
cacctgaaaactgtcttatt

SEQ ID NO: 2207 - DNA, 20 bp, Artificial sequence
  Synthetic Oligonucleotide
actggaatcagaaatagaat

SEQ ID NO: 2208 - DNA, 20 bp, Artificial sequence
  Synthetic Oligonucleotide
aattaagctgtccaagcgaa

SEQ ID NO: 2209 - DNA, 20 bp, Artificial sequence
  Synthetic Oligonucleotide
tgaatgtgaagaatgcccat

SEQ ID NO: 2210 - DNA, 20 bp, Artificial sequence
  Synthetic Oligonucleotide
tagcttgtgtgatgttaaat

SEQ ID NO: 2211 - DNA, 20 bp, Artificial sequence
  Synthetic Oligonucleotide
gactcatctttcctcattgg

SEQ ID NO: 2212 - DNA, 20 bp, Artificial sequence
  Synthetic Oligonucleotide
tgactctcctactagactgt

SEQ ID NO: 2213 - DNA, 20 bp, Artificial sequence
  Synthetic Oligonucleotide
cattctcttctttttattca

SEQ ID NO: 2214 - DNA, 20 bp, Artificial sequence
  Synthetic Oligonucleotide
aaaagattaggccctgggtt

SEQ ID NO: 2215 - DNA, 20 bp, Artificial sequence
  Synthetic Oligonucleotide
attatacatttccttagaat

SEQ ID NO: 2216 - DNA, 20 bp, Artificial sequence
  Synthetic Oligonucleotide
tatttatgtaaatttacttg

SEQ ID NO: 2217 - DNA, 20 bp, Artificial sequence
  Synthetic Oligonucleotide
atttttactgtggacataaa

SEQ ID NO: 2218 - DNA, 20 bp, Artificial sequence
  Synthetic Oligonucleotide
ggtacaaaaaacaggcttca

SEQ ID NO: 2219 - DNA, 20 bp, Artificial sequence
  Synthetic Oligonucleotide
aacaaagatgatgaacgatc

SEQ ID NO: 2220 - DNA, 20 bp, Artificial sequence
  Synthetic Oligonucleotide
atgaatgaacaacgaggaat

SEQ ID NO: 2221 - DNA, 20 bp, Artificial sequence
  Synthetic Oligonucleotide
tgtgacagaactatgtcaaa

SEQ ID NO: 2222 - DNA, 20 bp, Artificial sequence
  Synthetic Oligonucleotide
aatatagcatagtaattgag

SEQ ID NO: 2223 - DNA, 20 bp, Artificial sequence
  Synthetic Oligonucleotide
gtccaagacgatcaacagag

SEQ ID NO: 2224 - DNA, 20 bp, Artificial sequence
  Synthetic Oligonucleotide
agggaatgtaaacaatgcag

SEQ ID NO: 2225 - DNA, 20 bp, Artificial sequence
  Synthetic Oligonucleotide
tttcatagcttccaccacaa

SEQ ID NO: 2226 - DNA, 20 bp, Artificial sequence
  Synthetic Oligonucleotide
gtatttttctgaaattaaca

SEQ ID NO: 2227 - DNA, 20 bp, Artificial sequence
  Synthetic Oligonucleotide
cagccactttcagccacttc

SEQ ID NO: 2228 - DNA, 20 bp, Artificial sequence
  Synthetic Oligonucleotide
ttctttgtaatcaagtatcc

SEQ ID NO: 2229 - DNA, 20 bp, Artificial sequence
  Synthetic Oligonucleotide
ccaagccaagaaggttcaac

SEQ ID NO: 2230 - DNA, 20 bp, Artificial sequence
  Synthetic Oligonucleotide
tcaaactcttcagagtttca

SEQ ID NO: 2231 - DNA, 20 bp, Artificial sequence
  Synthetic Oligonucleotide
ggaggcaagaaaggcatagc

SEQ ID NO: 2232 - DNA, 20 bp, Artificial sequence
  Synthetic Oligonucleotide
gaaagatgcagtttctctac

SEQ ID NO: 2233 - DNA, 20 bp, Artificial sequence
  Synthetic Oligonucleotide
tcaacttcagcctgtccctt

SEQ ID NO: 2234 - DNA, 20 bp, Artificial sequence
  Synthetic Oligonucleotide
ttttctctcactagttgtaa

SEQ ID NO: 2235 - DNA, 20 bp, Artificial sequence
  Synthetic Oligonucleotide
tttcatatagtcggatgata

SEQ ID NO: 2236 - DNA, 20 bp, Artificial sequence
  Synthetic Oligonucleotide
gttcttcaccatcattaaaa

SEQ ID NO: 2237 - DNA, 20 bp, Artificial sequence
  Synthetic Oligonucleotide
aagcaggcgatccaaggaac

SEQ ID NO: 2238 - DNA, 20 bp, Artificial sequence
  Synthetic Oligonucleotide
aaatgagagctgtcctctgt

SEQ ID NO: 2239 - DNA, 20 bp, Artificial sequence
  Synthetic Oligonucleotide
agagggttttcactctccca

SEQ ID NO: 2240 - DNA, 20 bp, Artificial sequence
  Synthetic Oligonucleotide
tgttttttcattagtacttt

SEQ ID NO: 2241 - DNA, 20 bp, Artificial sequence
  Synthetic Oligonucleotide
aatatggtattcattttttt

SEQ ID NO: 2242 - DNA, 20 bp, Artificial sequence
  Synthetic Oligonucleotide
atgctcaggcttgggcaatt

SEQ ID NO: 2243 - DNA, 20 bp, Artificial sequence
  Synthetic Oligonucleotide
tggaatatcatgttaaatgg

SEQ ID NO: 2244 - DNA, 20 bp, Artificial sequence
  Synthetic Oligonucleotide
aaataaatactcaaggccat

SEQ ID NO: 2245 - DNA, 20 bp, Artificial sequence
  Synthetic Oligonucleotide
tattttcacccaactccata

SEQ ID NO: 2246 - DNA, 20 bp, Artificial sequence
  Synthetic Oligonucleotide
tttgcattctcatctagaat

SEQ ID NO: 2247 - DNA, 20 bp, Artificial sequence
  Synthetic Oligonucleotide
cccctgagtcctggagaacc

SEQ ID NO: 2248 - DNA, 20 bp, Artificial sequence
  Synthetic Oligonucleotide
attgggttttactctgccta

SEQ ID NO: 2249 - DNA, 20 bp, Artificial sequence
  Synthetic Oligonucleotide
ccacatgcaaaaatatttct

SEQ ID NO: 2250 - DNA, 20 bp, Artificial sequence
  Synthetic Oligonucleotide
acatctgtgtataaatatgt

SEQ ID NO: 2251 - DNA, 20 bp, Artificial sequence
  Synthetic Oligonucleotide
gatgaatattcaatggcatt

SEQ ID NO: 2252 - DNA, 20 bp, Artificial sequence
  Synthetic Oligonucleotide
aaaacacaaaggctcacgga

SEQ ID NO: 2253 - DNA, 20 bp, Artificial sequence
  Synthetic Oligonucleotide
ctgtcagtgccctggccact

SEQ ID NO: 2254 - DNA, 20 bp, Artificial sequence
  Synthetic Oligonucleotide
gtggctagcttctagccaag

SEQ ID NO: 2255 - DNA, 20 bp, Artificial sequence
  Synthetic Oligonucleotide
tgttattatcattcctcttt

SEQ ID NO: 2256 - DNA, 20 bp, Artificial sequence
  Synthetic Oligonucleotide
aaagccttttatatatgcat

SEQ ID NO: 2257 - DNA, 20 bp, Artificial sequence
  Synthetic Oligonucleotide
ctttttaagtcctccatatt

SEQ ID NO: 2258 - DNA, 20 bp, Artificial sequence
  Synthetic Oligonucleotide
agaaaacagcagccatagta

SEQ ID NO: 2259 - DNA, 20 bp, Artificial sequence
  Synthetic Oligonucleotide
aagtgattttctccacatca

SEQ ID NO: 2260 - DNA, 20 bp, Artificial sequence
  Synthetic Oligonucleotide
tgcatagtctgtaggtagta

SEQ ID NO: 2261 - DNA, 20 bp, Artificial sequence
  Synthetic Oligonucleotide
tgttgtcacccttgtaaaat

SEQ ID NO: 2262 - DNA, 20 bp, Artificial sequence
  Synthetic Oligonucleotide
aattcactgagggttagaat

SEQ ID NO: 2263 - DNA, 20 bp, Artificial sequence
  Synthetic Oligonucleotide
agcacatccccagagtctgt

SEQ ID NO: 2264 - DNA, 20 bp, Artificial sequence
  Synthetic Oligonucleotide
taaattgaaagaatagtaga

SEQ ID NO: 2265 - DNA, 20 bp, Artificial sequence
  Synthetic Oligonucleotide
aaatgcccaccagtctccaa

SEQ ID NO: 2266 - DNA, 20 bp, Artificial sequence
  Synthetic Oligonucleotide
aaaccttgatgtataaaggc

SEQ ID NO: 2267 - DNA, 20 bp, Artificial sequence
  Synthetic Oligonucleotide
tacacaagccacgaaaggat

SEQ ID NO: 2268 - DNA, 20 bp, Artificial sequence
  Synthetic Oligonucleotide
tcttcattgacacaccacac

SEQ ID NO: 2269 - DNA, 20 bp, Artificial sequence
  Synthetic Oligonucleotide
tcactctggccttctgctta

SEQ ID NO: 2270 - DNA, 20 bp, Artificial sequence
  Synthetic Oligonucleotide
atatccatataatttctcat

SEQ ID NO: 2271 - DNA, 20 bp, Artificial sequence
  Synthetic Oligonucleotide
gaattaaatgattaaagtat

SEQ ID NO: 2272 - DNA, 20 bp, Artificial sequence
  Synthetic Oligonucleotide
ttttgtaaattatttccaga

SEQ ID NO: 2273 - DNA, 20 bp, Artificial sequence
  Synthetic Oligonucleotide
aaaaattattttactgagtc

SEQ ID NO: 2274 - DNA, 20 bp, Artificial sequence
  Synthetic Oligonucleotide
tgagacaaacaaattatcaa

SEQ ID NO: 2275 - DNA, 20 bp, Artificial sequence
  Synthetic Oligonucleotide
cgctgttgaagaaacctagt

SEQ ID NO: 2276 - DNA, 20 bp, Artificial sequence
  Synthetic Oligonucleotide
gagcctggagggaaagacac

SEQ ID NO: 2277 - DNA, 20 bp, Artificial sequence
  Synthetic Oligonucleotide
gatcaaaggcaaatatgaaa

SEQ ID NO: 2278 - DNA, 20 bp, Artificial sequence
  Synthetic Oligonucleotide
atttctagcaaggtaatatg

SEQ ID NO: 2279 - DNA, 20 bp, Artificial sequence
  Synthetic Oligonucleotide
gtacaggatgcagctaccta

SEQ ID NO: 2280 - DNA, 20 bp, Artificial sequence
  Synthetic Oligonucleotide
gttactagaatgtagcagaa

SEQ ID NO: 2281 - DNA, 20 bp, Artificial sequence
  Synthetic Oligonucleotide
catctccctaatttctctaa

SEQ ID NO: 2282 - DNA, 20 bp, Artificial sequence
  Synthetic Oligonucleotide
gtcattttataaaatatggc

SEQ ID NO: 2283 - DNA, 20 bp, Artificial sequence
  Synthetic Oligonucleotide
aactgttacatactggaatc

SEQ ID NO: 2284 - DNA, 20 bp, Artificial sequence
  Synthetic Oligonucleotide
atgtgcaatttaatataatt

SEQ ID NO: 2285 - DNA, 20 bp, Artificial sequence
  Synthetic Oligonucleotide
acttgtggcccacaggtcgc

SEQ ID NO: 2286 - DNA, 20 bp, Artificial sequence
  Synthetic Oligonucleotide
tgttgaaatgtatagcttgt

SEQ ID NO: 2287 - DNA, 20 bp, Artificial sequence
  Synthetic Oligonucleotide
gacatgtgagatggtcatgc

SEQ ID NO: 2288 - DNA, 20 bp, Artificial sequence
  Synthetic Oligonucleotide
tcttcatagcttaaagtaaa

SEQ ID NO: 2289 - DNA, 20 bp, Artificial sequence
  Synthetic Oligonucleotide
gaatctacaaatctaacttt

SEQ ID NO: 2290 - DNA, 20 bp, Artificial sequence
  Synthetic Oligonucleotide
aaaattggaggcagagttta

SEQ ID NO: 2291 - DNA, 20 bp, Artificial sequence
  Synthetic Oligonucleotide
atattgttacagatacaatg

SEQ ID NO: 2292 - DNA, 20 bp, Artificial sequence
  Synthetic Oligonucleotide
ctccataatcctatatttat

SEQ ID NO: 2293 - DNA, 20 bp, Artificial sequence
  Synthetic Oligonucleotide
aagtatgtctaagcttttta

SEQ ID NO: 2294 - DNA, 20 bp, Artificial sequence
  Synthetic Oligonucleotide
ttgaaatttttctttgacca

SEQ ID NO: 2295 - DNA, 20 bp, Artificial sequence
  Synthetic Oligonucleotide
tttccatcttaaatgattag

SEQ ID NO: 2296 - DNA, 20 bp, Artificial sequence
  Synthetic Oligonucleotide
aatagaagaaggcactacag

SEQ ID NO: 2297 - DNA, 20 bp, Artificial sequence
  Synthetic Oligonucleotide
aaataaaaatataaagtggc

SEQ ID NO: 2298 - DNA, 20 bp, Artificial sequence
  Synthetic Oligonucleotide
tgaggcaaaatatagcatag

SEQ ID NO: 2299 - DNA, 20 bp, Artificial sequence
  Synthetic Oligonucleotide
ctgctgcacactcgcgactc

SEQ ID NO: 2300 - DNA, 20 bp, Artificial sequence
  Synthetic Oligonucleotide
tccacattattgcaaggaat

SEQ ID NO: 2301 - DNA, 20 bp, Artificial sequence
  Synthetic Oligonucleotide
cctatggagcaaacagcaac

SEQ ID NO: 2302 - DNA, 20 bp, Artificial sequence
  Synthetic Oligonucleotide
cttctgcattaactccaaaa

SEQ ID NO: 2303 - DNA, 20 bp, Artificial sequence
  Synthetic Oligonucleotide
ttacagccactttcagccac

SEQ ID NO: 2304 - DNA, 20 bp, Artificial sequence
  Synthetic Oligonucleotide
ttagtctgtatttcagcaac

SEQ ID NO: 2305 - DNA, 20 bp, Artificial sequence
  Synthetic Oligonucleotide
ttcttgctagtgtagatgct

SEQ ID NO: 2306 - DNA, 20 bp, Artificial sequence
  Synthetic Oligonucleotide
tgtcaaactcttcagagttt

SEQ ID NO: 2307 - DNA, 20 bp, Artificial sequence
  Synthetic Oligonucleotide
aagaccgcaagtgtggaaga

SEQ ID NO: 2308 - DNA, 20 bp, Artificial sequence
  Synthetic Oligonucleotide
ctgacatccagagatgtcag

SEQ ID NO: 2309 - DNA, 20 bp, Artificial sequence
  Synthetic Oligonucleotide
aagaagcgcgagcctttata

SEQ ID NO: 2310 - DNA, 20 bp, Artificial sequence
  Synthetic Oligonucleotide
aactgcagtgctgggtcttg

SEQ ID NO: 2311 - DNA, 20 bp, Artificial sequence
  Synthetic Oligonucleotide
gcatttcatatagtcggatg

SEQ ID NO: 2312 - DNA, 20 bp, Artificial sequence
  Synthetic Oligonucleotide
ttcctctgctttcttcatca

SEQ ID NO: 2313 - DNA, 20 bp, Artificial sequence
  Synthetic Oligonucleotide
atcctgtgctgtagggttct

SEQ ID NO: 2314 - DNA, 20 bp, Artificial sequence
  Synthetic Oligonucleotide
tcagcaacttcctcagaagt

SEQ ID NO: 2315 - DNA, 20 bp, Artificial sequence
  Synthetic Oligonucleotide
tggcctcctccagttcctat

SEQ ID NO: 2316 - DNA, 20 bp, Artificial sequence
  Synthetic Oligonucleotide
ctattatgtctaggaaagac

SEQ ID NO: 2317 - DNA, 20 bp, Artificial sequence
  Synthetic Oligonucleotide
ctccttaagagtccgggttt

SEQ ID NO: 2318 - DNA, 20 bp, Artificial sequence
  Synthetic Oligonucleotide
tgacactcataactactccg

SEQ ID NO: 2319 - DNA, 20 bp, Artificial sequence
  Synthetic Oligonucleotide
aatacaattaaattggtagt

SEQ ID NO: 2320 - DNA, 20 bp, Artificial sequence
  Synthetic Oligonucleotide
aaaatctacaacttaaccag

SEQ ID NO: 2321 - DNA, 20 bp, Artificial sequence
  Synthetic Oligonucleotide
aaaaagttaaaagcactact

SEQ ID NO: 2322 - DNA, 20 bp, Artificial sequence
  Synthetic Oligonucleotide
ctttaagaatatctcctaca

SEQ ID NO: 2323 - DNA, 20 bp, Artificial sequence
  Synthetic Oligonucleotide
agtgatcaacattcattttt

SEQ ID NO: 2324 - DNA, 20 bp, Artificial sequence
  Synthetic Oligonucleotide
ttattgttcagccccaccca

SEQ ID NO: 2325 - DNA, 20 bp, Artificial sequence
  Synthetic Oligonucleotide
ctatcctgtgaacaatattg

SEQ ID NO: 2326 - DNA, 20 bp, Artificial sequence
  Synthetic Oligonucleotide
tatatttatatacatctgtg

SEQ ID NO: 2327 - DNA, 20 bp, Artificial sequence
  Synthetic Oligonucleotide
agttaagtgaaacattagct

SEQ ID NO: 2328 - DNA, 20 bp, Artificial sequence
  Synthetic Oligonucleotide
aacaaatagacggtcaagat

SEQ ID NO: 2329 - DNA, 20 bp, Artificial sequence
  Synthetic Oligonucleotide
tccctgtccagacctcttta

SEQ ID NO: 2330 - DNA, 20 bp, Artificial sequence
  Synthetic Oligonucleotide
atactgccagagcctgaaaa

SEQ ID NO: 2331 - DNA, 20 bp, Artificial sequence
  Synthetic Oligonucleotide
ttagttagactgatgttaaa

SEQ ID NO: 2332 - DNA, 20 bp, Artificial sequence
  Synthetic Oligonucleotide
gaagaaattatttgtgcctc

SEQ ID NO: 2333 - DNA, 20 bp, Artificial sequence
  Synthetic Oligonucleotide
gaggtcctactattcaaatg

SEQ ID NO: 2334 - DNA, 20 bp, Artificial sequence
  Synthetic Oligonucleotide
cttctctttttcatactcag

SEQ ID NO: 2335 - DNA, 20 bp, Artificial sequence
  Synthetic Oligonucleotide
agaagactggttttacttta

SEQ ID NO: 2336 - DNA, 20 bp, Artificial sequence
  Synthetic Oligonucleotide
ggtgcatagtctgtaggtag

SEQ ID NO: 2337 - DNA, 20 bp, Artificial sequence
  Synthetic Oligonucleotide
ttcacaggtgtgtatttcac

SEQ ID NO: 2338 - DNA, 20 bp, Artificial sequence
  Synthetic Oligonucleotide
aaatcagtatccttgatttt

SEQ ID NO: 2339 - DNA, 20 bp, Artificial sequence
  Synthetic Oligonucleotide
ggaaaaagaactaataccct

SEQ ID NO: 2340 - DNA, 20 bp, Artificial sequence
  Synthetic Oligonucleotide
aaaatcctgttgggtagaaa

SEQ ID NO: 2341 - DNA, 20 bp, Artificial sequence
  Synthetic Oligonucleotide
cccttacagctagcaagcaa

SEQ ID NO: 2342 - DNA, 20 bp, Artificial sequence
  Synthetic Oligonucleotide
aacttttggagcctactgag

SEQ ID NO: 2343 - DNA, 20 bp, Artificial sequence
  Synthetic Oligonucleotide
tcattatatatttcaccata

SEQ ID NO: 2344 - DNA, 20 bp, Artificial sequence
  Synthetic Oligonucleotide
taagaataaggtataaatca

SEQ ID NO: 2345 - DNA, 20 bp, Artificial sequence
  Synthetic Oligonucleotide
attttaaattcccctactct

SEQ ID NO: 2346 - DNA, 20 bp, Artificial sequence
  Synthetic Oligonucleotide
tgagtgaaaaagctatatcc

SEQ ID NO: 2347 - DNA, 20 bp, Artificial sequence
  Synthetic Oligonucleotide
agagctatcctatcaacaaa

SEQ ID NO: 2348 - DNA, 20 bp, Artificial sequence
  Synthetic Oligonucleotide
cttacacacctctggtaact

SEQ ID NO: 2349 - DNA, 20 bp, Artificial sequence
  Synthetic Oligonucleotide
tttgtctgtgctctgaactt

SEQ ID NO: 2350 - DNA, 20 bp, Artificial sequence
  Synthetic Oligonucleotide
cctaattggagtaatttctt

SEQ ID NO: 2351 - DNA, 20 bp, Artificial sequence
  Synthetic Oligonucleotide
tccatacagtctaccaggtt

SEQ ID NO: 2352 - DNA, 20 bp, Artificial sequence
  Synthetic Oligonucleotide
ggcatcaaaaacattttctc

SEQ ID NO: 2353 - DNA, 20 bp, Artificial sequence
  Synthetic Oligonucleotide
agatgcctgctctgctaatg

SEQ ID NO: 2354 - DNA, 20 bp, Artificial sequence
  Synthetic Oligonucleotide
ttcacacataagtagaaatt

SEQ ID NO: 2355 - DNA, 20 bp, Artificial sequence
  Synthetic Oligonucleotide
ctgtataagatatacccatc

SEQ ID NO: 2356 - DNA, 20 bp, Artificial sequence
  Synthetic Oligonucleotide
tgctattcatatagagtctc

SEQ ID NO: 2357 - DNA, 20 bp, Artificial sequence
  Synthetic Oligonucleotide
attttggaaaccagtaacac

SEQ ID NO: 2358 - DNA, 20 bp, Artificial sequence
  Synthetic Oligonucleotide
tttgagtatgtcaccatgta

SEQ ID NO: 2359 - DNA, 20 bp, Artificial sequence
  Synthetic Oligonucleotide
attagttaggattgttggta

SEQ ID NO: 2360 - DNA, 20 bp, Artificial sequence
  Synthetic Oligonucleotide
aggattctcagatacagtgt

SEQ ID NO: 2361 - DNA, 20 bp, Artificial sequence
  Synthetic Oligonucleotide
aatcctatggtgagtacctc

SEQ ID NO: 2362 - DNA, 20 bp, Artificial sequence
  Synthetic Oligonucleotide
gatccaatggcaacaaccct

SEQ ID NO: 2363 - DNA, 20 bp, Artificial sequence
  Synthetic Oligonucleotide
ggaatgtaaggtgactctca

SEQ ID NO: 2364 - DNA, 20 bp, Artificial sequence
  Synthetic Oligonucleotide
agactagcaaaatagctttt

SEQ ID NO: 2365 - DNA, 20 bp, Artificial sequence
  Synthetic Oligonucleotide
gtggacctgaatttgatttg

SEQ ID NO: 2366 - DNA, 20 bp, Artificial sequence
  Synthetic Oligonucleotide
aggaagattcattaaacgga

SEQ ID NO: 2367 - DNA, 20 bp, Artificial sequence
  Synthetic Oligonucleotide
aaagatggagctcagcagtc

SEQ ID NO: 2368 - DNA, 20 bp, Artificial sequence
  Synthetic Oligonucleotide
tttgccttataactattttt

SEQ ID NO: 2369 - DNA, 20 bp, Artificial sequence
  Synthetic Oligonucleotide
attctgtttttgatctggag

SEQ ID NO: 2370 - DNA, 20 bp, Artificial sequence
  Synthetic Oligonucleotide
ccttgcccaattccatccat

SEQ ID NO: 2371 - DNA, 20 bp, Artificial sequence
  Synthetic Oligonucleotide
tattcttgtttgaaactggt

SEQ ID NO: 2372 - DNA, 20 bp, Artificial sequence
  Synthetic Oligonucleotide
ccctcacactagattatgag

SEQ ID NO: 2373 - DNA, 20 bp, Artificial sequence
  Synthetic Oligonucleotide
agaaaaactgtcagatgaat

SEQ ID NO: 2374 - DNA, 20 bp, Artificial sequence
  Synthetic Oligonucleotide
atattctagtgaagagacta

SEQ ID NO: 2375 - DNA, 20 bp, Artificial sequence
  Synthetic Oligonucleotide
ctttgcattgtacctggaca

SEQ ID NO: 2376 - DNA, 20 bp, Artificial sequence
  Synthetic Oligonucleotide
gacttccacattattgcaag

SEQ ID NO: 2377 - DNA, 20 bp, Artificial sequence
  Synthetic Oligonucleotide
atagtctcagtgaggagggc

SEQ ID NO: 2378 - DNA, 20 bp, Artificial sequence
  Synthetic Oligonucleotide
gagaatgtatatgcttctgc

SEQ ID NO: 2379 - DNA, 20 bp, Artificial sequence
  Synthetic Oligonucleotide
tatatccagggaagtgttgc

SEQ ID NO: 2380 - DNA, 20 bp, Artificial sequence
  Synthetic Oligonucleotide
agaaaaagatgctgacaatt

SEQ ID NO: 2381 - DNA, 20 bp, Artificial sequence
  Synthetic Oligonucleotide
gccttcacttccttcactat

SEQ ID NO: 2382 - DNA, 20 bp, Artificial sequence
  Synthetic Oligonucleotide
ccaaatgtgtcaaactcttc

SEQ ID NO: 2383 - DNA, 20 bp, Artificial sequence
  Synthetic Oligonucleotide
ttatggctaaataagagttc

SEQ ID NO: 2384 - DNA, 20 bp, Artificial sequence
  Synthetic Oligonucleotide
gatgcagttcatccaaagga

SEQ ID NO: 2385 - DNA, 20 bp, Artificial sequence
  Synthetic Oligonucleotide
ttttccgaagttttgccaaa

SEQ ID NO: 2386 - DNA, 20 bp, Artificial sequence
  Synthetic Oligonucleotide
gggtgttttggacaaccttc

SEQ ID NO: 2387 - DNA, 20 bp, Artificial sequence
  Synthetic Oligonucleotide
taaggcatttcatatagtcg

SEQ ID NO: 2388 - DNA, 20 bp, Artificial sequence
  Synthetic Oligonucleotide
tgagccttggttgatctgga

SEQ ID NO: 2389 - DNA, 20 bp, Artificial sequence
  Synthetic Oligonucleotide
aatcatggctgagtggaggt

SEQ ID NO: 2390 - DNA, 20 bp, Artificial sequence
  Synthetic Oligonucleotide
ttccttttcaacaggaagat

SEQ ID NO: 2391 - DNA, 20 bp, Artificial sequence
  Synthetic Oligonucleotide
ttcctagctgtgctgtcatc

SEQ ID NO: 2392 - DNA, 20 bp, Artificial sequence
  Synthetic Oligonucleotide
gaagcagattagaaaacaag

SEQ ID NO: 2393 - DNA, 20 bp, Artificial sequence
  Synthetic Oligonucleotide
ctttacctgctgcacactcg

SEQ ID NO: 2394 - DNA, 20 bp, Artificial sequence
  Synthetic Oligonucleotide
ccagagactggaaatgaaag

SEQ ID NO: 2395 - DNA, 20 bp, Artificial sequence
  Synthetic Oligonucleotide
tccattaatctattcaatta

SEQ ID NO: 2396 - DNA, 20 bp, Artificial sequence
  Synthetic Oligonucleotide
gtatcgattctattattaaa

SEQ ID NO: 2397 - DNA, 20 bp, Artificial sequence
  Synthetic Oligonucleotide
aatcaagctaccctaatcct

SEQ ID NO: 2398 - DNA, 20 bp, Artificial sequence
  Synthetic Oligonucleotide
taaatgagataaactcccag

SEQ ID NO: 2399 - DNA, 20 bp, Artificial sequence
  Synthetic Oligonucleotide
tattgggcaacaacctgaaa

SEQ ID NO: 2400 - DNA, 20 bp, Artificial sequence
  Synthetic Oligonucleotide
ttttagctgctactttcttg

SEQ ID NO: 2401 - DNA, 20 bp, Artificial sequence
  Synthetic Oligonucleotide
gatacataaaaaagagtaaa

SEQ ID NO: 2402 - DNA, 20 bp, Artificial sequence
  Synthetic Oligonucleotide
agattaaaacattatcagat

SEQ ID NO: 2403 - DNA, 20 bp, Artificial sequence
  Synthetic Oligonucleotide
acaactgttagtttccttga

SEQ ID NO: 2404 - DNA, 20 bp, Artificial sequence
  Synthetic Oligonucleotide
tttcaaaagcatatgcagca

SEQ ID NO: 2405 - DNA, 20 bp, Artificial sequence
  Synthetic Oligonucleotide
cagtcgaaatttcacaaagt

SEQ ID NO: 2406 - DNA, 20 bp, Artificial sequence
  Synthetic Oligonucleotide
cttaagtactgcttttaaaa

SEQ ID NO: 2407 - DNA, 20 bp, Artificial sequence
  Synthetic Oligonucleotide
cctcccctccttgggtaacc

SEQ ID NO: 2408 - DNA, 20 bp, Artificial sequence
  Synthetic Oligonucleotide
tcagcctttccttccacact

SEQ ID NO: 2409 - DNA, 20 bp, Artificial sequence
  Synthetic Oligonucleotide
tattacaccttaagaagatg

SEQ ID NO: 2410 - DNA, 20 bp, Artificial sequence
  Synthetic Oligonucleotide
ttacacaatttaaatgtaat

SEQ ID NO: 2411 - DNA, 20 bp, Artificial sequence
  Synthetic Oligonucleotide
ttagttccagaaaatactat

SEQ ID NO: 2412 - DNA, 20 bp, Artificial sequence
  Synthetic Oligonucleotide
ccagggtgcatagtctgtag

SEQ ID NO: 2413 - DNA, 20 bp, Artificial sequence
  Synthetic Oligonucleotide
cttctacaaaaaaaagtcag

SEQ ID NO: 2414 - DNA, 20 bp, Artificial sequence
  Synthetic Oligonucleotide
cactgaatttctaggaaaat

SEQ ID NO: 2415 - DNA, 20 bp, Artificial sequence
  Synthetic Oligonucleotide
agaatactgagcaaagacaa

SEQ ID NO: 2416 - DNA, 20 bp, Artificial sequence
  Synthetic Oligonucleotide
gtctaacacaactccaccct

SEQ ID NO: 2417 - DNA, 20 bp, Artificial sequence
  Synthetic Oligonucleotide
ccaagataacaggtaataga

SEQ ID NO: 2418 - DNA, 20 bp, Artificial sequence
  Synthetic Oligonucleotide
cttccagactggtgatagca

SEQ ID NO: 2419 - DNA, 20 bp, Artificial sequence
  Synthetic Oligonucleotide
agacacaatattttggaaca

SEQ ID NO: 2420 - DNA, 20 bp, Artificial sequence
  Synthetic Oligonucleotide
gttagaaattttaaaagact

SEQ ID NO: 2421 - DNA, 20 bp, Artificial sequence
  Synthetic Oligonucleotide
ctggaatagggtctagcagc

SEQ ID NO: 2422 - DNA, 20 bp, Artificial sequence
  Synthetic Oligonucleotide
aaaaatgggcccctattaaa

SEQ ID NO: 2423 - DNA, 20 bp, Artificial sequence
  Synthetic Oligonucleotide
tcccttaaatatacttaaaa

SEQ ID NO: 2424 - DNA, 20 bp, Artificial sequence
  Synthetic Oligonucleotide
gttgttaaaactcattgcta

SEQ ID NO: 2425 - DNA, 20 bp, Artificial sequence
  Synthetic Oligonucleotide
gaccacttctcaaactatta

SEQ ID NO: 2426 - DNA, 20 bp, Artificial sequence
  Synthetic Oligonucleotide
ctcccaaacaatctatgtca

SEQ ID NO: 2427 - DNA, 20 bp, Artificial sequence
  Synthetic Oligonucleotide
aaccgatcaaagtacctagc

SEQ ID NO: 2428 - DNA, 20 bp, Artificial sequence
  Synthetic Oligonucleotide
cacagtgacaaaattcatga

SEQ ID NO: 2429 - DNA, 20 bp, Artificial sequence
  Synthetic Oligonucleotide
tatctcttaacccagagaat

SEQ ID NO: 2430 - DNA, 20 bp, Artificial sequence
  Synthetic Oligonucleotide
ctgggactagaagctgtgca

SEQ ID NO: 2431 - DNA, 20 bp, Artificial sequence
  Synthetic Oligonucleotide
acttaattactccacagaat

SEQ ID NO: 2432 - DNA, 20 bp, Artificial sequence
  Synthetic Oligonucleotide
ttctctcatttgaatatcag

SEQ ID NO: 2433 - DNA, 20 bp, Artificial sequence
  Synthetic Oligonucleotide
taaaaagagttaaatcccct

SEQ ID NO: 2434 - DNA, 20 bp, Artificial sequence
  Synthetic Oligonucleotide
tgtacaaagtatatcttttt

SEQ ID NO: 2435 - DNA, 20 bp, Artificial sequence
  Synthetic Oligonucleotide
attagattgtaaatatgtta

SEQ ID NO: 2436 - DNA, 20 bp, Artificial sequence
  Synthetic Oligonucleotide
ccaagtttctacatttctaa

SEQ ID NO: 2437 - DNA, 20 bp, Artificial sequence
  Synthetic Oligonucleotide
ttgttgagaaaagcacagat

SEQ ID NO: 2438 - DNA, 20 bp, Artificial sequence
  Synthetic Oligonucleotide
cattggcattcattcaatcc

SEQ ID NO: 2439 - DNA, 20 bp, Artificial sequence
  Synthetic Oligonucleotide
ggtatctgcaaggaacctca

SEQ ID NO: 2440 - DNA, 20 bp, Artificial sequence
  Synthetic Oligonucleotide
ttcaattgtatgagggcctg

SEQ ID NO: 2441 - DNA, 20 bp, Artificial sequence
  Synthetic Oligonucleotide
ttacttcctgctcaaactga

SEQ ID NO: 2442 - DNA, 20 bp, Artificial sequence
  Synthetic Oligonucleotide
caggagctctgctctcaggc

SEQ ID NO: 2443 - DNA, 20 bp, Artificial sequence
  Synthetic Oligonucleotide
gtactactctttctttcttt

SEQ ID NO: 2444 - DNA, 20 bp, Artificial sequence
  Synthetic Oligonucleotide
ttttttctgatttgatttgt

SEQ ID NO: 2445 - DNA, 20 bp, Artificial sequence
  Synthetic Oligonucleotide
gcatgcaattctatattgca

SEQ ID NO: 2446 - DNA, 20 bp, Artificial sequence
  Synthetic Oligonucleotide
cccacttccttccaacaagg

SEQ ID NO: 2447 - DNA, 20 bp, Artificial sequence
  Synthetic Oligonucleotide
gaaaggttattgcccaagtt

SEQ ID NO: 2448 - DNA, 20 bp, Artificial sequence
  Synthetic Oligonucleotide
gccacatcagcatggcaaac

SEQ ID NO: 2449 - DNA, 20 bp, Artificial sequence
  Synthetic Oligonucleotide
taccaaagctatctaattca

SEQ ID NO: 2450 - DNA, 20 bp, Artificial sequence
  Synthetic Oligonucleotide
ttaaacgaggtaatgtgtgt

SEQ ID NO: 2451 - DNA, 20 bp, Artificial sequence
  Synthetic Oligonucleotide
ttaagctttgcattgtacct

SEQ ID NO: 2452 - DNA, 20 bp, Artificial sequence
  Synthetic Oligonucleotide
aggacttccacattattgca

SEQ ID NO: 2453 - DNA, 20 bp, Artificial sequence
  Synthetic Oligonucleotide
cttgatttaagaaaatagtc

SEQ ID NO: 2454 - DNA, 20 bp, Artificial sequence
  Synthetic Oligonucleotide
ggagaatgtatatgcttctg

SEQ ID NO: 2455 - DNA, 20 bp, Artificial sequence
  Synthetic Oligonucleotide
ggaccactgctgccattata

SEQ ID NO: 2456 - DNA, 20 bp, Artificial sequence
  Synthetic Oligonucleotide
gaatattactaagtcaaatg

SEQ ID NO: 2457 - DNA, 20 bp, Artificial sequence
  Synthetic Oligonucleotide
cctacactaattgaattaga

SEQ ID NO: 2458 - DNA, 20 bp, Artificial sequence
  Synthetic Oligonucleotide
tccaaatgtgtcaaactctt

SEQ ID NO: 2459 - DNA, 20 bp, Artificial sequence
  Synthetic Oligonucleotide
tctgattatggctaaataag

SEQ ID NO: 2460 - DNA, 20 bp, Artificial sequence
  Synthetic Oligonucleotide
gttaagatgcagttcatcca

SEQ ID NO: 2461 - DNA, 20 bp, Artificial sequence
  Synthetic Oligonucleotide
cgtttatgatggttttccga

SEQ ID NO: 2462 - DNA, 20 bp, Artificial sequence
  Synthetic Oligonucleotide
gacatgtagttctttggaaa

SEQ ID NO: 2463 - DNA, 20 bp, Artificial sequence
  Synthetic Oligonucleotide
ataaggcatttcatatagtc

SEQ ID NO: 2464 - DNA, 20 bp, Artificial sequence
  Synthetic Oligonucleotide
gtgagccttggttgatctgg

SEQ ID NO: 2465 - DNA, 20 bp, Artificial sequence
  Synthetic Oligonucleotide
gggtttcaggtctcggtata

SEQ ID NO: 2466 - DNA, 20 bp, Artificial sequence
  Synthetic Oligonucleotide
caggagagtaccagactgtg

SEQ ID NO: 2467 - DNA, 20 bp, Artificial sequence
  Synthetic Oligonucleotide
ccagcatgacatttttaagg

SEQ ID NO: 2468 - DNA, 20 bp, Artificial sequence
  Synthetic Oligonucleotide
aagcattagaatgaagcaga

SEQ ID NO: 2469 - DNA, 20 bp, Artificial sequence
  Synthetic Oligonucleotide
gcctttacctgctgcacact

SEQ ID NO: 2470 - DNA, 20 bp, Artificial sequence
  Synthetic Oligonucleotide
ctctaaattaattacttaac

SEQ ID NO: 2471 - DNA, 20 bp, Artificial sequence
  Synthetic Oligonucleotide
tgattaaatagaatctctgg

SEQ ID NO: 2472 - DNA, 20 bp, Artificial sequence
  Synthetic Oligonucleotide
aaatgtactatttaaagaca

SEQ ID NO: 2473 - DNA, 20 bp, Artificial sequence
  Synthetic Oligonucleotide
ggctgtcccatcactaggtc

SEQ ID NO: 2474 - DNA, 20 bp, Artificial sequence
  Synthetic Oligonucleotide
gttagacttatcaagctcta

SEQ ID NO: 2475 - DNA, 20 bp, Artificial sequence
  Synthetic Oligonucleotide
tttgatcaagccagtaagtt

SEQ ID NO: 2476 - DNA, 20 bp, Artificial sequence
  Synthetic Oligonucleotide
tgtttaaaaaaaggctgttt

SEQ ID NO: 2477 - DNA, 20 bp, Artificial sequence
  Synthetic Oligonucleotide
attatcttagggaaaggaca

SEQ ID NO: 2478 - DNA, 20 bp, Artificial sequence
  Synthetic Oligonucleotide
tgtgctactctgacacctgg

SEQ ID NO: 2479 - DNA, 20 bp, Artificial sequence
  Synthetic Oligonucleotide
gtatatttgtcacaactgtt

SEQ ID NO: 2480 - DNA, 20 bp, Artificial sequence
  Synthetic Oligonucleotide
gctttttcaaaagcatatgc

SEQ ID NO: 2481 - DNA, 20 bp, Artificial sequence
  Synthetic Oligonucleotide
tgtaaccagtcctcagacac

SEQ ID NO: 2482 - DNA, 20 bp, Artificial sequence
  Synthetic Oligonucleotide
acataaaaagttttaactta

SEQ ID NO: 2483 - DNA, 20 bp, Artificial sequence
  Synthetic Oligonucleotide
aaagtcccagtttaaacaca

SEQ ID NO: 2484 - DNA, 20 bp, Artificial sequence
  Synthetic Oligonucleotide
ttttctttgggcctcagcct

SEQ ID NO: 2485 - DNA, 20 bp, Artificial sequence
  Synthetic Oligonucleotide
gaggctgcctattacacctt

SEQ ID NO: 2486 - DNA, 20 bp, Artificial sequence
  Synthetic Oligonucleotide
ttttgcattacacaatttaa

SEQ ID NO: 2487 - DNA, 20 bp, Artificial sequence
  Synthetic Oligonucleotide
tggagttaggccatatgaat

SEQ ID NO: 2488 - DNA, 20 bp, Artificial sequence
  Synthetic Oligonucleotide
gtccagggtgcatagtctgt

SEQ ID NO: 2489 - DNA, 20 bp, Artificial sequence
  Synthetic Oligonucleotide
taccagtatcttaaattcag

SEQ ID NO: 2490 - DNA, 20 bp, Artificial sequence
  Synthetic Oligonucleotide
agttcccaaattctttccaa

SEQ ID NO: 2491 - DNA, 20 bp, Artificial sequence
  Synthetic Oligonucleotide
aatggcagggctcttacatt

SEQ ID NO: 2492 - DNA, 20 bp, Artificial sequence
  Synthetic Oligonucleotide
gagccaccctgcatgaagct

SEQ ID NO: 2493 - DNA, 20 bp, Artificial sequence
  Synthetic Oligonucleotide
gcactgcatgctggccctac

SEQ ID NO: 2494 - DNA, 20 bp, Artificial sequence
  Synthetic Oligonucleotide
ttatataatgtggtgaatgg

SEQ ID NO: 2495 - DNA, 20 bp, Artificial sequence
  Synthetic Oligonucleotide
tgacttgagacacaatattt

SEQ ID NO: 2496 - DNA, 20 bp, Artificial sequence
  Synthetic Oligonucleotide
attgtgaacaaagaaaatcc

SEQ ID NO: 2497 - DNA, 20 bp, Artificial sequence
  Synthetic Oligonucleotide
caaatcaatcaacggttaca

SEQ ID NO: 2498 - DNA, 20 bp, Artificial sequence
  Synthetic Oligonucleotide
taattggaggaaattcaacc

SEQ ID NO: 2499 - DNA, 20 bp, Artificial sequence
  Synthetic Oligonucleotide
gaaaaaacatcccttaaata

SEQ ID NO: 2500 - DNA, 20 bp, Artificial sequence
  Synthetic Oligonucleotide
taaaagttgtaatattcatt

SEQ ID NO: 2501 - DNA, 20 bp, Artificial sequence
  Synthetic Oligonucleotide
ttcagagtcttgagtttcat

SEQ ID NO: 2502 - DNA, 20 bp, Artificial sequence
  Synthetic Oligonucleotide
tctttagattgtgtaattgg

SEQ ID NO: 2503 - DNA, 20 bp, Artificial sequence
  Synthetic Oligonucleotide
cacttttagcatatttgtca

SEQ ID NO: 2504 - DNA, 20 bp, Artificial sequence
  Synthetic Oligonucleotide
aaatggaacagaactaagct

SEQ ID NO: 2505 - DNA, 20 bp, Artificial sequence
  Synthetic Oligonucleotide
caaatggttactcaagagac

SEQ ID NO: 2506 - DNA, 20 bp, Artificial sequence
  Synthetic Oligonucleotide
atttcagcatagctagtgac

SEQ ID NO: 2507 - DNA, 20 bp, Artificial sequence
  Synthetic Oligonucleotide
ctttcatggagtttcaactt

SEQ ID NO: 2508 - DNA, 20 bp, Artificial sequence
  Synthetic Oligonucleotide
tcccatgttgtgtactttat

SEQ ID NO: 2509 - DNA, 20 bp, Artificial sequence
  Synthetic Oligonucleotide
tgcacacaacacaagtgatt

SEQ ID NO: 2510 - DNA, 20 bp, Artificial sequence
  Synthetic Oligonucleotide
tctccattccacaacatata

SEQ ID NO: 2511 - DNA, 20 bp, Artificial sequence
  Synthetic Oligonucleotide
atggaaagcctctacctatt

SEQ ID NO: 2512 - DNA, 20 bp, Artificial sequence
  Synthetic Oligonucleotide
tggaggcagctaggagtctg

SEQ ID NO: 2513 - DNA, 20 bp, Artificial sequence
  Synthetic Oligonucleotide
caaaggcctaaagccaatta

SEQ ID NO: 2514 - DNA, 20 bp, Artificial sequence
  Synthetic Oligonucleotide
aggccttccagaccttctcg

SEQ ID NO: 2515 - DNA, 20 bp, Artificial sequence
  Synthetic Oligonucleotide
gatataaagcctctggtatc

SEQ ID NO: 2516 - DNA, 20 bp, Artificial sequence
  Synthetic Oligonucleotide
cctgaactttcaattgtatg

SEQ ID NO: 2517 - DNA, 20 bp, Artificial sequence
  Synthetic Oligonucleotide
ctaaatgatttacttcctgc

SEQ ID NO: 2518 - DNA, 20 bp, Artificial sequence
  Synthetic Oligonucleotide
tgccataggacccagaatta

SEQ ID NO: 2519 - DNA, 20 bp, Artificial sequence
  Synthetic Oligonucleotide
cagaaagttatcaaatatgt

SEQ ID NO: 2520 - DNA, 20 bp, Artificial sequence
  Synthetic Oligonucleotide
agctcgaaaaagaaattgca

SEQ ID NO: 2521 - DNA, 20 bp, Artificial sequence
  Synthetic Oligonucleotide
taacttgaaaagaaaatctc

SEQ ID NO: 2522 - DNA, 20 bp, Artificial sequence
  Synthetic Oligonucleotide
cctaatcacattgacaactg

SEQ ID NO: 2523 - DNA, 20 bp, Artificial sequence
  Synthetic Oligonucleotide
gagatgactgaagatgtgaa

SEQ ID NO: 2524 - DNA, 20 bp, Artificial sequence
  Synthetic Oligonucleotide
tttccctttcaacctaagac

SEQ ID NO: 2525 - DNA, 20 bp, Artificial sequence
  Synthetic Oligonucleotide
ctttacttgaagcataaatt

SEQ ID NO: 2526 - DNA, 20 bp, Artificial sequence
  Synthetic Oligonucleotide
cccaaagttacaatgttaaa

SEQ ID NO: 2527 - DNA, 20 bp, Artificial sequence
  Synthetic Oligonucleotide
actggcattatgaactgtta

SEQ ID NO: 2528 - DNA, 20 bp, Artificial sequence
  Synthetic Oligonucleotide
tgaggacttccacattattg

SEQ ID NO: 2529 - DNA, 20 bp, Artificial sequence
  Synthetic Oligonucleotide
cttccagccaaaacaattta

SEQ ID NO: 2530 - DNA, 20 bp, Artificial sequence
  Synthetic Oligonucleotide
tcaggagaatgtatatgctt

SEQ ID NO: 2531 - DNA, 20 bp, Artificial sequence
  Synthetic Oligonucleotide
gcctccagctgcactggtaa

SEQ ID NO: 2532 - DNA, 20 bp, Artificial sequence
  Synthetic Oligonucleotide
gtaatcatccatagctactt

SEQ ID NO: 2533 - DNA, 20 bp, Artificial sequence
  Synthetic Oligonucleotide
aatacggcatctcggtaaaa

SEQ ID NO: 2534 - DNA, 20 bp, Artificial sequence
  Synthetic Oligonucleotide
aagtccaaatgtgtcaaact

SEQ ID NO: 2535 - DNA, 20 bp, Artificial sequence
  Synthetic Oligonucleotide
tgatctgattatggctaaat

SEQ ID NO: 2536 - DNA, 20 bp, Artificial sequence
  Synthetic Oligonucleotide
gtctttggctttacatccta

SEQ ID NO: 2537 - DNA, 20 bp, Artificial sequence
  Synthetic Oligonucleotide
ttttcaagttctacatagca

SEQ ID NO: 2538 - DNA, 20 bp, Artificial sequence
  Synthetic Oligonucleotide
tgtgacatgtagttctttgg

SEQ ID NO: 2539 - DNA, 20 bp, Artificial sequence
  Synthetic Oligonucleotide
gtgaaatctcaagtaatcga

SEQ ID NO: 2540 - DNA, 20 bp, Artificial sequence
  Synthetic Oligonucleotide
atggtgagccttggttgatc

SEQ ID NO: 2541 - DNA, 20 bp, Artificial sequence
  Synthetic Oligonucleotide
tgccgtagtcagcaatcttt

SEQ ID NO: 2542 - DNA, 20 bp, Artificial sequence
  Synthetic Oligonucleotide
ttttctagggtatgtctctt

SEQ ID NO: 2543 - DNA, 20 bp, Artificial sequence
  Synthetic Oligonucleotide
agcaagattgtatctctttc

SEQ ID NO: 2544 - DNA, 20 bp, Artificial sequence
  Synthetic Oligonucleotide
aatgatgtaggatctgcagc

SEQ ID NO: 2545 - DNA, 20 bp, Artificial sequence
  Synthetic Oligonucleotide
aatgagttgaagtgaaaaca

SEQ ID NO: 2546 - DNA, 20 bp, Artificial sequence
  Synthetic Oligonucleotide
tatcaacagattaacaaaga

SEQ ID NO: 2547 - DNA, 20 bp, Artificial sequence
  Synthetic Oligonucleotide
ttggtgaagcaacagtatca

SEQ ID NO: 2548 - DNA, 20 bp, Artificial sequence
  Synthetic Oligonucleotide
tacagatgtgctgaaagtta

SEQ ID NO: 2549 - DNA, 20 bp, Artificial sequence
  Synthetic Oligonucleotide
taaaaccaatgtattgaatg

SEQ ID NO: 2550 - DNA, 20 bp, Artificial sequence
  Synthetic Oligonucleotide
ataactgtgttctacttttc

SEQ ID NO: 2551 - DNA, 20 bp, Artificial sequence
  Synthetic Oligonucleotide
agacttaaaaatgaaagaca

SEQ ID NO: 2552 - DNA, 20 bp, Artificial sequence
  Synthetic Oligonucleotide
aaaatataagtcttagggac

SEQ ID NO: 2553 - DNA, 20 bp, Artificial sequence
  Synthetic Oligonucleotide
gtgcctaaaaaagaatgtat

SEQ ID NO: 2554 - DNA, 20 bp, Artificial sequence
  Synthetic Oligonucleotide
agtagcatttccctgatcac

SEQ ID NO: 2555 - DNA, 20 bp, Artificial sequence
  Synthetic Oligonucleotide
aaaaaaaaacctaatagacg

SEQ ID NO: 2556 - DNA, 20 bp, Artificial sequence
  Synthetic Oligonucleotide
aaatatctctaacaacaatt

SEQ ID NO: 2557 - DNA, 20 bp, Artificial sequence
  Synthetic Oligonucleotide
gtagccattttttctaaaaa

SEQ ID NO: 2558 - DNA, 20 bp, Artificial sequence
  Synthetic Oligonucleotide
taatgattaaggaataattt

SEQ ID NO: 2559 - DNA, 20 bp, Artificial sequence
  Synthetic Oligonucleotide
atcagaaccatgttctcact

SEQ ID NO: 2560 - DNA, 20 bp, Artificial sequence
  Synthetic Oligonucleotide
ctatcatcctctgcaccaca

SEQ ID NO: 2561 - DNA, 20 bp, Artificial sequence
  Synthetic Oligonucleotide
ccctcctccaactttcagtc

SEQ ID NO: 2562 - DNA, 20 bp, Artificial sequence
  Synthetic Oligonucleotide
tatgtctttattcttaacat

SEQ ID NO: 2563 - DNA, 20 bp, Artificial sequence
  Synthetic Oligonucleotide
tattcagctttctttgcttt

SEQ ID NO: 2564 - DNA, 20 bp, Artificial sequence
  Synthetic Oligonucleotide
gatacttttaaatctaatag

SEQ ID NO: 2565 - DNA, 20 bp, Artificial sequence
  Synthetic Oligonucleotide
cttcttttacctccaaaccc

SEQ ID NO: 2566 - DNA, 20 bp, Artificial sequence
  Synthetic Oligonucleotide
aatggtgaataaccatgctg

SEQ ID NO: 2567 - DNA, 20 bp, Artificial sequence
  Synthetic Oligonucleotide
cctaaaggaccctattactt

SEQ ID NO: 2568 - DNA, 20 bp, Artificial sequence
  Synthetic Oligonucleotide
cagtgcccaggtggtaatga

SEQ ID NO: 2569 - DNA, 20 bp, Artificial sequence
  Synthetic Oligonucleotide
tctctcagtcttcaaccttc

SEQ ID NO: 2570 - DNA, 20 bp, Artificial sequence
  Synthetic Oligonucleotide
atgtgcaaaacactagtatc

SEQ ID NO: 2571 - DNA, 20 bp, Artificial sequence
  Synthetic Oligonucleotide
attgtcaggaagcaaatgat

SEQ ID NO: 2572 - DNA, 20 bp, Artificial sequence
  Synthetic Oligonucleotide
tgaaaaatatgaatacctca

SEQ ID NO: 2573 - DNA, 20 bp, Artificial sequence
  Synthetic Oligonucleotide
acaatttaacttaccaagga

SEQ ID NO: 2574 - DNA, 20 bp, Artificial sequence
  Synthetic Oligonucleotide
gatgaaactggcaccaagaa

SEQ ID NO: 2575 - DNA, 20 bp, Artificial sequence
  Synthetic Oligonucleotide
gtgggtcacctttctttctt

SEQ ID NO: 2576 - DNA, 20 bp, Artificial sequence
  Synthetic Oligonucleotide
atcaaagaggactcattaat

SEQ ID NO: 2577 - DNA, 20 bp, Artificial sequence
  Synthetic Oligonucleotide
caaatctaccgtttctagga

SEQ ID NO: 2578 - DNA, 20 bp, Artificial sequence
  Synthetic Oligonucleotide
gttaactagttgctatatga

SEQ ID NO: 2579 - DNA, 20 bp, Artificial sequence
  Synthetic Oligonucleotide
actcggaaagtttcccaatt

SEQ ID NO: 2580 - DNA, 20 bp, Artificial sequence
  Synthetic Oligonucleotide
gaataggaaagtctacaaat

SEQ ID NO: 2581 - DNA, 20 bp, Artificial sequence
  Synthetic Oligonucleotide
taatatccagagtgccgtta

SEQ ID NO: 2582 - DNA, 20 bp, Artificial sequence
  Synthetic Oligonucleotide
cttaactaaacccaaattct

SEQ ID NO: 2583 - DNA, 20 bp, Artificial sequence
  Synthetic Oligonucleotide
tcagacaagttgctcttggt

SEQ ID NO: 2584 - DNA, 20 bp, Artificial sequence
  Synthetic Oligonucleotide
aagaggtttgtatttaattt

SEQ ID NO: 2585 - DNA, 20 bp, Artificial sequence
  Synthetic Oligonucleotide
cacttcataagtattgaagg

SEQ ID NO: 2586 - DNA, 20 bp, Artificial sequence
  Synthetic Oligonucleotide
aatagttctcaccacataaa

SEQ ID NO: 2587 - DNA, 20 bp, Artificial sequence
  Synthetic Oligonucleotide
tctcatatagtgccttgaaa

SEQ ID NO: 2588 - DNA, 20 bp, Artificial sequence
  Synthetic Oligonucleotide
agtcatgttcaataaaaata

SEQ ID NO: 2589 - DNA, 20 bp, Artificial sequence
  Synthetic Oligonucleotide
aggtgggaatattctaagta

SEQ ID NO: 2590 - DNA, 20 bp, Artificial sequence
  Synthetic Oligonucleotide
ctacaaaagtttaccgagga

SEQ ID NO: 2591 - DNA, 20 bp, Artificial sequence
  Synthetic Oligonucleotide
gaaagattcagataatcctt

SEQ ID NO: 2592 - DNA, 20 bp, Artificial sequence
  Synthetic Oligonucleotide
ataatttctcacaagactta

SEQ ID NO: 2593 - DNA, 20 bp, Artificial sequence
  Synthetic Oligonucleotide
gtaattttacttacaaataa

SEQ ID NO: 2594 - DNA, 20 bp, Artificial sequence
  Synthetic Oligonucleotide
taagagaaatttatgaatta

SEQ ID NO: 2595 - DNA, 20 bp, Artificial sequence
  Synthetic Oligonucleotide
aacctaaagacatccaatca

SEQ ID NO: 2596 - DNA, 20 bp, Artificial sequence
  Synthetic Oligonucleotide
caacaggaccaaataggaat

SEQ ID NO: 2597 - DNA, 20 bp, Artificial sequence
  Synthetic Oligonucleotide
gggaccctgagctaagacat

SEQ ID NO: 2598 - DNA, 20 bp, Artificial sequence
  Synthetic Oligonucleotide
aaatggccttaatgttctcc

SEQ ID NO: 2599 - DNA, 20 bp, Artificial sequence
  Synthetic Oligonucleotide
tttgtgactcaaagctaata

SEQ ID NO: 2600 - DNA, 20 bp, Artificial sequence
  Synthetic Oligonucleotide
ccattttccccttttaaaca

SEQ ID NO: 2601 - DNA, 20 bp, Artificial sequence
  Synthetic Oligonucleotide
aagaccatccatatgacact

SEQ ID NO: 2602 - DNA, 20 bp, Artificial sequence
  Synthetic Oligonucleotide
aacagcttaacctttctata

SEQ ID NO: 2603 - DNA, 20 bp, Artificial sequence
  Synthetic Oligonucleotide
gaggagatctaaggtcttca

SEQ ID NO: 2604 - DNA, 20 bp, Artificial sequence
  Synthetic Oligonucleotide
atgaggacttccacattatt

SEQ ID NO: 2605 - DNA, 20 bp, Artificial sequence
  Synthetic Oligonucleotide
acaggcttccagccaaaaca

SEQ ID NO: 2606 - DNA, 20 bp, Artificial sequence
  Synthetic Oligonucleotide
ttcaggagaatgtatatgct

SEQ ID NO: 2607 - DNA, 20 bp, Artificial sequence
  Synthetic Oligonucleotide
ataaaatgtaaaatagctcg

SEQ ID NO: 2608 - DNA, 20 bp, Artificial sequence
  Synthetic Oligonucleotide
attctgatcacacgctctct

SEQ ID NO: 2609 - DNA, 20 bp, Artificial sequence
  Synthetic Oligonucleotide
gtaatacggcatctcggtaa

SEQ ID NO: 2610 - DNA, 20 bp, Artificial sequence
  Synthetic Oligonucleotide
caagtccaaatgtgtcaaac

SEQ ID NO: 2611 - DNA, 20 bp, Artificial sequence
  Synthetic Oligonucleotide
ctgatctgattatggctaaa

SEQ ID NO: 2612 - DNA, 20 bp, Artificial sequence
  Synthetic Oligonucleotide
ttttaccactcccagtattt

SEQ ID NO: 2613 - DNA, 20 bp, Artificial sequence
  Synthetic Oligonucleotide
cacatttttacgctccgata

SEQ ID NO: 2614 - DNA, 20 bp, Artificial sequence
  Synthetic Oligonucleotide
ctgtgacatgtagttctttg

SEQ ID NO: 2615 - DNA, 20 bp, Artificial sequence
  Synthetic Oligonucleotide
cttcaggagaccaatttaag

SEQ ID NO: 2616 - DNA, 20 bp, Artificial sequence
  Synthetic Oligonucleotide
aatggtgagccttggttgat

SEQ ID NO: 2617 - DNA, 20 bp, Artificial sequence
  Synthetic Oligonucleotide
gccctctgatgtttttatcc

SEQ ID NO: 2618 - DNA, 20 bp, Artificial sequence
  Synthetic Oligonucleotide
tcatcttttctagggtatgt

SEQ ID NO: 2619 - DNA, 20 bp, Artificial sequence
  Synthetic Oligonucleotide
tttcagctaattcttttctc

SEQ ID NO: 2620 - DNA, 20 bp, Artificial sequence
  Synthetic Oligonucleotide
gaaaagtgttagatatttat

SEQ ID NO: 2621 - DNA, 20 bp, Artificial sequence
  Synthetic Oligonucleotide
gaatgagttgaagtgaaaac

SEQ ID NO: 2622 - DNA, 20 bp, Artificial sequence
  Synthetic Oligonucleotide
atccagtaatctcatcgctg

SEQ ID NO: 2623 - DNA, 20 bp, Artificial sequence
  Synthetic Oligonucleotide
attctgaacagcttctggtg

SEQ ID NO: 2624 - DNA, 20 bp, Artificial sequence
  Synthetic Oligonucleotide
ttttcctggaaacacattct

SEQ ID NO: 2625 - DNA, 20 bp, Artificial sequence
  Synthetic Oligonucleotide
aagggcaggaatgaccacta

SEQ ID NO: 2626 - DNA, 20 bp, Artificial sequence
  Synthetic Oligonucleotide
gcaattgaagaaagtctact

SEQ ID NO: 2627 - DNA, 20 bp, Artificial sequence
  Synthetic Oligonucleotide
gtttctccagcaccaagccc

SEQ ID NO: 2628 - DNA, 20 bp, Artificial sequence
  Synthetic Oligonucleotide
ttccagaagggcaaccaatg

SEQ ID NO: 2629 - DNA, 20 bp, Artificial sequence
  Synthetic Oligonucleotide
gaactggacaagttaatcct

SEQ ID NO: 2630 - DNA, 20 bp, Artificial sequence
  Synthetic Oligonucleotide
tgctgttctagacaatttgg

SEQ ID NO: 2631 - DNA, 20 bp, Artificial sequence
  Synthetic Oligonucleotide
aagccttggtcaattataaa

SEQ ID NO: 2632 - DNA, 20 bp, Artificial sequence
  Synthetic Oligonucleotide
cacttgccattatcaaatat

SEQ ID NO: 2633 - DNA, 20 bp, Artificial sequence
  Synthetic Oligonucleotide
tgtatgcaaccttgggacct

SEQ ID NO: 2634 - DNA, 20 bp, Artificial sequence
  Synthetic Oligonucleotide
tggaaagcatttacatagaa

SEQ ID NO: 2635 - DNA, 20 bp, Artificial sequence
  Synthetic Oligonucleotide
tgttaactgaaacttgtgca

SEQ ID NO: 2636 - DNA, 20 bp, Artificial sequence
  Synthetic Oligonucleotide
tctatcatcctctgcaccac

SEQ ID NO: 2637 - DNA, 20 bp, Artificial sequence
  Synthetic Oligonucleotide
taaggaaggcagccttgata

SEQ ID NO: 2638 - DNA, 20 bp, Artificial sequence
  Synthetic Oligonucleotide
tttataaaaatgttcacact

SEQ ID NO: 2639 - DNA, 20 bp, Artificial sequence
  Synthetic Oligonucleotide
aatctcatccatctgtaatt

SEQ ID NO: 2640 - DNA, 20 bp, Artificial sequence
  Synthetic Oligonucleotide
tactctgatttcctcatctt

SEQ ID NO: 2641 - DNA, 20 bp, Artificial sequence
  Synthetic Oligonucleotide
ctttacaatgtcttctttta

SEQ ID NO: 2642 - DNA, 20 bp, Artificial sequence
  Synthetic Oligonucleotide
ataaatggtgaataaccatg

SEQ ID NO: 2643 - DNA, 20 bp, Artificial sequence
  Synthetic Oligonucleotide
tggataacacctaaaggacc

SEQ ID NO: 2644 - DNA, 20 bp, Artificial sequence
  Synthetic Oligonucleotide
gtatttggagcagtgcccag

SEQ ID NO: 2645 - DNA, 20 bp, Artificial sequence
  Synthetic Oligonucleotide
gtaccttaacacagtaaata

SEQ ID NO: 2646 - DNA, 20 bp, Artificial sequence
  Synthetic Oligonucleotide
taatctactatgtgcaaaac

SEQ ID NO: 2647 - DNA, 20 bp, Artificial sequence
  Synthetic Oligonucleotide
tctacattgtcaggaagcaa

SEQ ID NO: 2648 - DNA, 20 bp, Artificial sequence
  Synthetic Oligonucleotide
atctctcacagatgcaaaat

SEQ ID NO: 2649 - DNA, 20 bp, Artificial sequence
  Synthetic Oligonucleotide
ataatcacaattgcacaatt

SEQ ID NO: 2650 - DNA, 20 bp, Artificial sequence
  Synthetic Oligonucleotide
gaatcattaggtaaatatat

SEQ ID NO: 2651 - DNA, 20 bp, Artificial sequence
  Synthetic Oligonucleotide
agtggagaagagagaaagac

SEQ ID NO: 2652 - DNA, 20 bp, Artificial sequence
  Synthetic Oligonucleotide
tatcaaaaacaatttgcttt

SEQ ID NO: 2653 - DNA, 20 bp, Artificial sequence
  Synthetic Oligonucleotide
acagtctcttttcttatctg

SEQ ID NO: 2654 - DNA, 20 bp, Artificial sequence
  Synthetic Oligonucleotide
tttagtgtcaattctaaaaa

SEQ ID NO: 2655 - DNA, 20 bp, Artificial sequence
  Synthetic Oligonucleotide
cagtagctataatgctttaa

SEQ ID NO: 2656 - DNA, 20 bp, Artificial sequence
  Synthetic Oligonucleotide
tttagatttcatttaagaaa

SEQ ID NO: 2657 - DNA, 20 bp, Artificial sequence
  Synthetic Oligonucleotide
aattacatgtccaacaagag

SEQ ID NO: 2658 - DNA, 20 bp, Artificial sequence
  Synthetic Oligonucleotide
aataaaagtatcttccaaac

SEQ ID NO: 2659 - DNA, 20 bp, Artificial sequence
  Synthetic Oligonucleotide
aaattcacaaaagtttctgc

SEQ ID NO: 2660 - DNA, 20 bp, Artificial sequence
  Synthetic Oligonucleotide
tttcatatctcttttatcat

SEQ ID NO: 2661 - DNA, 20 bp, Artificial sequence
  Synthetic Oligonucleotide
ttttgctttgtcaaattcac

SEQ ID NO: 2662 - DNA, 20 bp, Artificial sequence
  Synthetic Oligonucleotide
ctataattgaatatactatt

SEQ ID NO: 2663 - DNA, 20 bp, Artificial sequence
  Synthetic Oligonucleotide
attaaatcaatctaatgcat

SEQ ID NO: 2664 - DNA, 20 bp, Artificial sequence
  Synthetic Oligonucleotide
ctcaatccccaaggagtttg

SEQ ID NO: 2665 - DNA, 20 bp, Artificial sequence
  Synthetic Oligonucleotide
ctttcaccctgaacacacag

SEQ ID NO: 2666 - DNA, 20 bp, Artificial sequence
  Synthetic Oligonucleotide
ctcaaccctcacccatgcag

SEQ ID NO: 2667 - DNA, 20 bp, Artificial sequence
  Synthetic Oligonucleotide
cctgcttataatctctggtt

SEQ ID NO: 2668 - DNA, 20 bp, Artificial sequence
  Synthetic Oligonucleotide
tctgaaggcttactatttta

SEQ ID NO: 2669 - DNA, 20 bp, Artificial sequence
  Synthetic Oligonucleotide
actacagcatttcatgtgat

SEQ ID NO: 2670 - DNA, 20 bp, Artificial sequence
  Synthetic Oligonucleotide
atgtatagccacctgtaatt

SEQ ID NO: 2671 - DNA, 20 bp, Artificial sequence
  Synthetic Oligonucleotide
cttggataattatcataatg

SEQ ID NO: 2672 - DNA, 20 bp, Artificial sequence
  Synthetic Oligonucleotide
tctcttgggttcatgcctga

SEQ ID NO: 2673 - DNA, 20 bp, Artificial sequence
  Synthetic Oligonucleotide
taaatatttttgtagctcta

SEQ ID NO: 2674 - DNA, 20 bp, Artificial sequence
  Synthetic Oligonucleotide
tgtttctagggaccctgagc

SEQ ID NO: 2675 - DNA, 20 bp, Artificial sequence
  Synthetic Oligonucleotide
aaatgttgaaattgttacaa

SEQ ID NO: 2676 - DNA, 20 bp, Artificial sequence
  Synthetic Oligonucleotide
aaatgacaattaggagggtc

SEQ ID NO: 2677 - DNA, 20 bp, Artificial sequence
  Synthetic Oligonucleotide
cttgcaaaactttgtttcat

SEQ ID NO: 2678 - DNA, 20 bp, Artificial sequence
  Synthetic Oligonucleotide
aatttataccagtcttatgt

SEQ ID NO: 2679 - DNA, 20 bp, Artificial sequence
  Synthetic Oligonucleotide
attcttaattatgtgagtct

SEQ ID NO: 2680 - DNA, 20 bp, Artificial sequence
  Synthetic Oligonucleotide
attttacctgaagttaggag

SEQ ID NO: 2681 - DNA, 20 bp, Artificial sequence
  Synthetic Oligonucleotide
catgaggacttccacattat

SEQ ID NO: 2682 - DNA, 20 bp, Artificial sequence
  Synthetic Oligonucleotide
ttatttagtgcccagcatgc

SEQ ID NO: 2683 - DNA, 20 bp, Artificial sequence
  Synthetic Oligonucleotide
cttcaggagaatgtatatgc

SEQ ID NO: 2684 - DNA, 20 bp, Artificial sequence
  Synthetic Oligonucleotide
attctgtatcctccctggat

SEQ ID NO: 2685 - DNA, 20 bp, Artificial sequence
  Synthetic Oligonucleotide
ctgttattctgatcacacgc

SEQ ID NO: 2686 - DNA, 20 bp, Artificial sequence
  Synthetic Oligonucleotide
tgtaatacggcatctcggta

SEQ ID NO: 2687 - DNA, 20 bp, Artificial sequence
  Synthetic Oligonucleotide
gcaagtccaaatgtgtcaaa

SEQ ID NO: 2688 - DNA, 20 bp, Artificial sequence
  Synthetic Oligonucleotide
gctgatctgattatggctaa

SEQ ID NO: 2689 - DNA, 20 bp, Artificial sequence
  Synthetic Oligonucleotide
ggtggttttaccactcccag

SEQ ID NO: 2690 - DNA, 20 bp, Artificial sequence
  Synthetic Oligonucleotide
ggcacatttttacgctccga

SEQ ID NO: 2691 - DNA, 20 bp, Artificial sequence
  Synthetic Oligonucleotide
tactgtgacatgtagttctt

SEQ ID NO: 2692 - DNA, 20 bp, Artificial sequence
  Synthetic Oligonucleotide
ataagcttcaggagaccaat

SEQ ID NO: 2693 - DNA, 20 bp, Artificial sequence
  Synthetic Oligonucleotide
ggaatggtgagccttggttg

SEQ ID NO: 2694 - DNA, 20 bp, Artificial sequence
  Synthetic Oligonucleotide
catttcctctggcaacttca

SEQ ID NO: 2695 - DNA, 20 bp, Artificial sequence
  Synthetic Oligonucleotide
aattgcaatacaaacaagtg

SEQ ID NO: 2696 - DNA, 20 bp, Artificial sequence
  Synthetic Oligonucleotide
ataattttcctatccaaaga

SEQ ID NO: 2697 - DNA, 20 bp, Artificial sequence
  Synthetic Oligonucleotide
caactgaaaagtgttagata

SEQ ID NO: 2698 - DNA, 20 bp, Artificial sequence
  Synthetic Oligonucleotide
atacttggaatagtcaagtc

SEQ ID NO: 2699 - DNA, 20 bp, Artificial sequence
  Synthetic Oligonucleotide
tagcacagccatgatgaaac

SEQ ID NO: 2700 - DNA, 20 bp, Artificial sequence
  Synthetic Oligonucleotide
ttggatcttttccagattaa

SEQ ID NO: 2701 - DNA, 20 bp, Artificial sequence
  Synthetic Oligonucleotide
aaaagatttaaagttaatga

SEQ ID NO: 2702 - DNA, 20 bp, Artificial sequence
  Synthetic Oligonucleotide
acttcagtgtttgtcactta

SEQ ID NO: 2703 - DNA, 20 bp, Artificial sequence
  Synthetic Oligonucleotide
aatttctatgatttctggtg

SEQ ID NO: 2704 - DNA, 20 bp, Artificial sequence
  Synthetic Oligonucleotide
actgagctacttttgtcttc

SEQ ID NO: 2705 - DNA, 20 bp, Artificial sequence
  Synthetic Oligonucleotide
ttggagaatgacttttgcat

SEQ ID NO: 2706 - DNA, 20 bp, Artificial sequence
  Synthetic Oligonucleotide
tgcatttctttatgaaaaca

SEQ ID NO: 2707 - DNA, 20 bp, Artificial sequence
  Synthetic Oligonucleotide
aaagttacatatgacatgac

SEQ ID NO: 2708 - DNA, 20 bp, Artificial sequence
  Synthetic Oligonucleotide
agaagccttggtcaattata

SEQ ID NO: 2709 - DNA, 20 bp, Artificial sequence
  Synthetic Oligonucleotide
taactatctcaaattctcac

SEQ ID NO: 2710 - DNA, 20 bp, Artificial sequence
  Synthetic Oligonucleotide
gatgtctaacatatcatatt

SEQ ID NO: 2711 - DNA, 20 bp, Artificial sequence
  Synthetic Oligonucleotide
tcactcagctttttgggagt

SEQ ID NO: 2712 - DNA, 20 bp, Artificial sequence
  Synthetic Oligonucleotide
ttgactagaatgcagtaggt

SEQ ID NO: 2713 - DNA, 20 bp, Artificial sequence
  Synthetic Oligonucleotide
tgtatctagtctctctccct

SEQ ID NO: 2714 - DNA, 20 bp, Artificial sequence
  Synthetic Oligonucleotide
ataatgttttccaaacctaa

SEQ ID NO: 2715 - DNA, 20 bp, Artificial sequence
  Synthetic Oligonucleotide
ccattaattattttaaatag

SEQ ID NO: 2716 - DNA, 20 bp, Artificial sequence
  Synthetic Oligonucleotide
aaatttccctccaacaaggt

SEQ ID NO: 2717 - DNA, 20 bp, Artificial sequence
  Synthetic Oligonucleotide
atattagaagtgcaaatact

SEQ ID NO: 2718 - DNA, 20 bp, Artificial sequence
  Synthetic Oligonucleotide
ctttaaaatcattcctttac

SEQ ID NO: 2719 - DNA, 20 bp, Artificial sequence
  Synthetic Oligonucleotide
ttagcacattctctgaactt

SEQ ID NO: 2720 - DNA, 20 bp, Artificial sequence
  Synthetic Oligonucleotide
aagattagactggataacac

SEQ ID NO: 2721 - DNA, 20 bp, Artificial sequence
  Synthetic Oligonucleotide
acatttaaataataatgaag

SEQ ID NO: 2722 - DNA, 20 bp, Artificial sequence
  Synthetic Oligonucleotide
atcaatgtcagaatagcatg

SEQ ID NO: 2723 - DNA, 20 bp, Artificial sequence
  Synthetic Oligonucleotide
tgccaaattgtcctcaaaag

SEQ ID NO: 2724 - DNA, 20 bp, Artificial sequence
  Synthetic Oligonucleotide
ctagagaaaacattaatcta

SEQ ID NO: 2725 - DNA, 20 bp, Artificial sequence
  Synthetic Oligonucleotide
aaaatacctttacacaaatt

SEQ ID NO: 2726 - DNA, 20 bp, Artificial sequence
  Synthetic Oligonucleotide
ttgttcctagctttggcata

SEQ ID NO: 2727 - DNA, 20 bp, Artificial sequence
  Synthetic Oligonucleotide
atggaaggaatcattaggta

SEQ ID NO: 2728 - DNA, 20 bp, Artificial sequence
  Synthetic Oligonucleotide
gtatttagcaaggcaaagaa

SEQ ID NO: 2729 - DNA, 20 bp, Artificial sequence
  Synthetic Oligonucleotide
aaattgcataaattcatatg

SEQ ID NO: 2730 - DNA, 20 bp, Artificial sequence
  Synthetic Oligonucleotide
ctgtgaaacacaatttggga

SEQ ID NO: 2731 - DNA, 20 bp, Artificial sequence
  Synthetic Oligonucleotide
acatgatgtcagtagctata

SEQ ID NO: 2732 - DNA, 20 bp, Artificial sequence
  Synthetic Oligonucleotide
ttcacactaaatggcccctg

SEQ ID NO: 2733 - DNA, 20 bp, Artificial sequence
  Synthetic Oligonucleotide
taattggatgaataaatttt

SEQ ID NO: 2734 - DNA, 20 bp, Artificial sequence
  Synthetic Oligonucleotide
taagaggatagtttctacaa

SEQ ID NO: 2735 - DNA, 20 bp, Artificial sequence
  Synthetic Oligonucleotide
tggcttgaaaaccaagtcat

SEQ ID NO: 2736 - DNA, 20 bp, Artificial sequence
  Synthetic Oligonucleotide
tctttcatatctcttttatc

SEQ ID NO: 2737 - DNA, 20 bp, Artificial sequence
  Synthetic Oligonucleotide
tgatccttgtcatggcagtt

SEQ ID NO: 2738 - DNA, 20 bp, Artificial sequence
  Synthetic Oligonucleotide
aatcaacattttctgaatct

SEQ ID NO: 2739 - DNA, 20 bp, Artificial sequence
  Synthetic Oligonucleotide
tttatattaaatcaatctaa

SEQ ID NO: 2740 - DNA, 20 bp, Artificial sequence
  Synthetic Oligonucleotide
aagagctctgctactccatc

SEQ ID NO: 2741 - DNA, 20 bp, Artificial sequence
  Synthetic Oligonucleotide
taaagaacttgagaaggtga

SEQ ID NO: 2742 - DNA, 20 bp, Artificial sequence
  Synthetic Oligonucleotide
ccactgttaactaacagtgt

SEQ ID NO: 2743 - DNA, 20 bp, Artificial sequence
  Synthetic Oligonucleotide
ctatagccactactaatcag

SEQ ID NO: 2744 - DNA, 20 bp, Artificial sequence
  Synthetic Oligonucleotide
attctgaaggcttactattt

SEQ ID NO: 2745 - DNA, 20 bp, Artificial sequence
  Synthetic Oligonucleotide
ttctctgccccatgatgtca

SEQ ID NO: 2746 - DNA, 20 bp, Artificial sequence
  Synthetic Oligonucleotide
ggtgatttaattgagttgca

SEQ ID NO: 2747 - DNA, 20 bp, Artificial sequence
  Synthetic Oligonucleotide
taaatgttcaatgtattgtt

SEQ ID NO: 2748 - DNA, 20 bp, Artificial sequence
  Synthetic Oligonucleotide
gagagatgagtagaaaggag

SEQ ID NO: 2749 - DNA, 20 bp, Artificial sequence
  Synthetic Oligonucleotide
gcacattatctttaataaat

SEQ ID NO: 2750 - DNA, 20 bp, Artificial sequence
  Synthetic Oligonucleotide
ataacccatctcaggctctg

SEQ ID NO: 2751 - DNA, 20 bp, Artificial sequence
  Synthetic Oligonucleotide
ctactgtgttcaagatttta

SEQ ID NO: 2752 - DNA, 20 bp, Artificial sequence
  Synthetic Oligonucleotide
agcacagatggcaaaaagct

SEQ ID NO: 2753 - DNA, 20 bp, Artificial sequence
  Synthetic Oligonucleotide
gaaatattatatctgtaact

SEQ ID NO: 2754 - DNA, 20 bp, Artificial sequence
  Synthetic Oligonucleotide
aatctgcttctcttgtggga

SEQ ID NO: 2755 - DNA, 20 bp, Artificial sequence
  Synthetic Oligonucleotide
caaataccttggaactgaat

SEQ ID NO: 2756 - DNA, 20 bp, Artificial sequence
  Synthetic Oligonucleotide
tctcaacaaattcagtcagt

SEQ ID NO: 2757 - DNA, 20 bp, Artificial sequence
  Synthetic Oligonucleotide
ccactcatgaggacttccac

SEQ ID NO: 2758 - DNA, 20 bp, Artificial sequence
  Synthetic Oligonucleotide
aggagattatttagtgccca

SEQ ID NO: 2759 - DNA, 20 bp, Artificial sequence
  Synthetic Oligonucleotide
gccacttcaggagaatgtat

SEQ ID NO: 2760 - DNA, 20 bp, Artificial sequence
  Synthetic Oligonucleotide
atatttagcttatgatgaaa

SEQ ID NO: 2761 - DNA, 20 bp, Artificial sequence
  Synthetic Oligonucleotide
acctttcccaatgcttatcg

SEQ ID NO: 2762 - DNA, 20 bp, Artificial sequence
  Synthetic Oligonucleotide
gcaaatttggtgagcaacgc

SEQ ID NO: 2763 - DNA, 20 bp, Artificial sequence
  Synthetic Oligonucleotide
atcaagattagcaatacaac

SEQ ID NO: 2764 - DNA, 20 bp, Artificial sequence
  Synthetic Oligonucleotide
caagatgctgatctgattat

SEQ ID NO: 2765 - DNA, 20 bp, Artificial sequence
  Synthetic Oligonucleotide
tatagaattcctcacgacct

SEQ ID NO: 2766 - DNA, 20 bp, Artificial sequence
  Synthetic Oligonucleotide
caattggcacatttttacgc

SEQ ID NO: 2767 - DNA, 20 bp, Artificial sequence
  Synthetic Oligonucleotide
taaaatactgtgacatgtag

SEQ ID NO: 2768 - DNA, 20 bp, Artificial sequence
  Synthetic Oligonucleotide
ccacaacttggcccaaaaga

SEQ ID NO: 2769 - DNA, 20 bp, Artificial sequence
  Synthetic Oligonucleotide
gtcagccaaaatcaagtcag

SEQ ID NO: 2770 - DNA, 20 bp, Artificial sequence
  Synthetic Oligonucleotide
ggtaattttccttgtatttc

SEQ ID NO: 2771 - DNA, 20 bp, Artificial sequence
  Synthetic Oligonucleotide
ggagtactgacatttcctat

SEQ ID NO: 2772 - DNA, 20 bp, Artificial sequence
  Synthetic Oligonucleotide
ataagaaatataacattgtg

SEQ ID NO: 2773 - DNA, 20 bp, Artificial sequence
  Synthetic Oligonucleotide
cctcaaattattacataggt

SEQ ID NO: 2774 - DNA, 20 bp, Artificial sequence
  Synthetic Oligonucleotide
taagacatcactttctttag

SEQ ID NO: 2775 - DNA, 20 bp, Artificial sequence
  Synthetic Oligonucleotide
gaatcaaatattggctgtgc

SEQ ID NO: 2776 - DNA, 20 bp, Artificial sequence
  Synthetic Oligonucleotide
catatatgtaccctctagag

SEQ ID NO: 2777 - DNA, 20 bp, Artificial sequence
  Synthetic Oligonucleotide
ctgatacatagaattacaga

SEQ ID NO: 2778 - DNA, 20 bp, Artificial sequence
  Synthetic Oligonucleotide
gccaaagttttctcagggaa

SEQ ID NO: 2779 - DNA, 20 bp, Artificial sequence
  Synthetic Oligonucleotide
gggcccacataaatcattct

SEQ ID NO: 2780 - DNA, 20 bp, Artificial sequence
  Synthetic Oligonucleotide
ctctccactccatgtctctg

SEQ ID NO: 2781 - DNA, 20 bp, Artificial sequence
  Synthetic Oligonucleotide
acaataatgtaacatatttt

SEQ ID NO: 2782 - DNA, 20 bp, Artificial sequence
  Synthetic Oligonucleotide
agcaaacatttaaaagccca

SEQ ID NO: 2783 - DNA, 20 bp, Artificial sequence
  Synthetic Oligonucleotide
cataattagattacatagtt

SEQ ID NO: 2784 - DNA, 20 bp, Artificial sequence
  Synthetic Oligonucleotide
tttatgagagtcctacctgc

SEQ ID NO: 2785 - DNA, 20 bp, Artificial sequence
  Synthetic Oligonucleotide
tagaagtccggaaaaatata

SEQ ID NO: 2786 - DNA, 20 bp, Artificial sequence
  Synthetic Oligonucleotide
tcttactcaatagtcacctt

SEQ ID NO: 2787 - DNA, 20 bp, Artificial sequence
  Synthetic Oligonucleotide
ttagaatattaatatagtcc

SEQ ID NO: 2788 - DNA, 20 bp, Artificial sequence
  Synthetic Oligonucleotide
actgatctgattcaatggta

SEQ ID NO: 2789 - DNA, 20 bp, Artificial sequence
  Synthetic Oligonucleotide
cagaacaaagtatcatccct

SEQ ID NO: 2790 - DNA, 20 bp, Artificial sequence
  Synthetic Oligonucleotide
ctttattaagctacactgta

SEQ ID NO: 2791 - DNA, 20 bp, Artificial sequence
  Synthetic Oligonucleotide
agataaatttaacccattac

SEQ ID NO: 2792 - DNA, 20 bp, Artificial sequence
  Synthetic Oligonucleotide
acgaatcatgccacagtgaa

SEQ ID NO: 2793 - DNA, 20 bp, Artificial sequence
  Synthetic Oligonucleotide
tactagaacacagtgaaatg

SEQ ID NO: 2794 - DNA, 20 bp, Artificial sequence
  Synthetic Oligonucleotide
aatacatagtctcccttgac

SEQ ID NO: 2795 - DNA, 20 bp, Artificial sequence
  Synthetic Oligonucleotide
attcttaatctcccgtgaac

SEQ ID NO: 2796 - DNA, 20 bp, Artificial sequence
  Synthetic Oligonucleotide
catggttcaggagggaagag

SEQ ID NO: 2797 - DNA, 20 bp, Artificial sequence
  Synthetic Oligonucleotide
tccttggaggatccaaacta

SEQ ID NO: 2798 - DNA, 20 bp, Artificial sequence
  Synthetic Oligonucleotide
tcataaagaacttaaatgtc

SEQ ID NO: 2799 - DNA, 20 bp, Artificial sequence
  Synthetic Oligonucleotide
atgggaaattatcccgaagc

SEQ ID NO: 2800 - DNA, 20 bp, Artificial sequence
  Synthetic Oligonucleotide
caaaatacttcaacacttca

SEQ ID NO: 2801 - DNA, 20 bp, Artificial sequence
  Synthetic Oligonucleotide
aatataacaaaaatctgatt

SEQ ID NO: 2802 - DNA, 20 bp, Artificial sequence
  Synthetic Oligonucleotide
aacccacaccattaggtaga

SEQ ID NO: 2803 - DNA, 20 bp, Artificial sequence
  Synthetic Oligonucleotide
tgcaaaaaccagaggcacgg

SEQ ID NO: 2804 - DNA, 20 bp, Artificial sequence
  Synthetic Oligonucleotide
ttttaaatcaaattggatga

SEQ ID NO: 2805 - DNA, 20 bp, Artificial sequence
  Synthetic Oligonucleotide
cccctctatagtatacaaaa

SEQ ID NO: 2806 - DNA, 20 bp, Artificial sequence
  Synthetic Oligonucleotide
ttaacctggaagctaaacag

SEQ ID NO: 2807 - DNA, 20 bp, Artificial sequence
  Synthetic Oligonucleotide
tgagaggtgatgacagagct

SEQ ID NO: 2808 - DNA, 20 bp, Artificial sequence
  Synthetic Oligonucleotide
tgcacagaagagttcattgc

SEQ ID NO: 2809 - DNA, 20 bp, Artificial sequence
  Synthetic Oligonucleotide
taaaaagttgtcttcaaagg

SEQ ID NO: 2810 - DNA, 20 bp, Artificial sequence
  Synthetic Oligonucleotide
cttggttatttgtaaaatgt

SEQ ID NO: 2811 - DNA, 20 bp, Artificial sequence
  Synthetic Oligonucleotide
ttatgtcaaagctacagaga

SEQ ID NO: 2812 - DNA, 20 bp, Artificial sequence
  Synthetic Oligonucleotide
ttttccaaattcctttgtat

SEQ ID NO: 2813 - DNA, 20 bp, Artificial sequence
  Synthetic Oligonucleotide
gaaacaatgaacatcagtat

SEQ ID NO: 2814 - DNA, 20 bp, Artificial sequence
  Synthetic Oligonucleotide
aactgctgcagactaccaga

SEQ ID NO: 2815 - DNA, 20 bp, Artificial sequence
  Synthetic Oligonucleotide
agcatttaaattcaacctaa

SEQ ID NO: 2816 - DNA, 20 bp, Artificial sequence
  Synthetic Oligonucleotide
gtaaggttgagaacaagtgc

SEQ ID NO: 2817 - DNA, 20 bp, Artificial sequence
  Synthetic Oligonucleotide
agtagattctgttatacaaa

SEQ ID NO: 2818 - DNA, 20 bp, Artificial sequence
  Synthetic Oligonucleotide
aaaagagattatgtcagatt

SEQ ID NO: 2819 - DNA, 20 bp, Artificial sequence
  Synthetic Oligonucleotide
gtactgtcagaattaaattt

SEQ ID NO: 2820 - DNA, 20 bp, Artificial sequence
  Synthetic Oligonucleotide
gatttgttatttaaagtaag

SEQ ID NO: 2821 - DNA, 20 bp, Artificial sequence
  Synthetic Oligonucleotide
acagtgtaaagttttcatct

SEQ ID NO: 2822 - DNA, 20 bp, Artificial sequence
  Synthetic Oligonucleotide
gagttgcatatggtttagga

SEQ ID NO: 2823 - DNA, 20 bp, Artificial sequence
  Synthetic Oligonucleotide
ttctcatccagtgcacacat

SEQ ID NO: 2824 - DNA, 20 bp, Artificial sequence
  Synthetic Oligonucleotide
cctgaaagtaagcagataaa

SEQ ID NO: 2825 - DNA, 20 bp, Artificial sequence
  Synthetic Oligonucleotide
aattcatgccattccagaat

SEQ ID NO: 2826 - DNA, 20 bp, Artificial sequence
  Synthetic Oligonucleotide
ataagaagattgttcctctc

SEQ ID NO: 2827 - DNA, 20 bp, Artificial sequence
  Synthetic Oligonucleotide
agagaaataaatgctcatgg

SEQ ID NO: 2828 - DNA, 20 bp, Artificial sequence
  Synthetic Oligonucleotide
tatggaactttaaagagtta

SEQ ID NO: 2829 - DNA, 20 bp, Artificial sequence
  Synthetic Oligonucleotide
actttacttacttttggtta

SEQ ID NO: 2830 - DNA, 20 bp, Artificial sequence
  Synthetic Oligonucleotide
agactatgattaaaacaaac

SEQ ID NO: 2831 - DNA, 20 bp, Artificial sequence
  Synthetic Oligonucleotide
acatcattgccctgtttgga

SEQ ID NO: 2832 - DNA, 20 bp, Artificial sequence
  Synthetic Oligonucleotide
tttgttctcaacaaattcag

SEQ ID NO: 2833 - DNA, 20 bp, Artificial sequence
  Synthetic Oligonucleotide
gccactcatgaggacttcca

SEQ ID NO: 2834 - DNA, 20 bp, Artificial sequence
  Synthetic Oligonucleotide
aaggagattatttagtgccc

SEQ ID NO: 2835 - DNA, 20 bp, Artificial sequence
  Synthetic Oligonucleotide
cagccacttcaggagaatgt

SEQ ID NO: 2836 - DNA, 20 bp, Artificial sequence
  Synthetic Oligonucleotide
catatttagcttatgatgaa

SEQ ID NO: 2837 - DNA, 20 bp, Artificial sequence
  Synthetic Oligonucleotide
cacctttcccaatgcttatc

SEQ ID NO: 2838 - DNA, 20 bp, Artificial sequence
  Synthetic Oligonucleotide
ttcatgatcaaaaatgggcc

SEQ ID NO: 2839 - DNA, 20 bp, Artificial sequence
  Synthetic Oligonucleotide
atctaaaaccactgagggtc

SEQ ID NO: 2840 - DNA, 20 bp, Artificial sequence
  Synthetic Oligonucleotide
accataaatatgctttttca

SEQ ID NO: 2841 - DNA, 20 bp, Artificial sequence
  Synthetic Oligonucleotide
actatagaattcctcacgac

SEQ ID NO: 2842 - DNA, 20 bp, Artificial sequence
  Synthetic Oligonucleotide
tcaattggcacatttttacg

SEQ ID NO: 2843 - DNA, 20 bp, Artificial sequence
  Synthetic Oligonucleotide
tttttctaggagcttaaaat

SEQ ID NO: 2844 - DNA, 20 bp, Artificial sequence
  Synthetic Oligonucleotide
tccacaacttggcccaaaag

SEQ ID NO: 2845 - DNA, 20 bp, Artificial sequence
  Synthetic Oligonucleotide
ggtcagccaaaatcaagtca

SEQ ID NO: 2846 - DNA, 20 bp, Artificial sequence
  Synthetic Oligonucleotide
atttctttccgttgaatttg

SEQ ID NO: 2847 - DNA, 20 bp, Artificial sequence
  Synthetic Oligonucleotide
atcggccttataaattttag

SEQ ID NO: 2848 - DNA, 20 bp, Artificial sequence
  Synthetic Oligonucleotide
aagaatttaccgaaagtact

SEQ ID NO: 2849 - DNA, 20 bp, Artificial sequence
  Synthetic Oligonucleotide
aaatttctgggtttcctatg

SEQ ID NO: 2850 - DNA, 20 bp, Artificial sequence
  Synthetic Oligonucleotide
agctctttgatcctcagtga

SEQ ID NO: 2851 - DNA, 20 bp, Artificial sequence
  Synthetic Oligonucleotide
aaaaagagaaagtgcatata

SEQ ID NO: 2852 - DNA, 20 bp, Artificial sequence
  Synthetic Oligonucleotide
tgtacaggaatatgactaga

SEQ ID NO: 2853 - DNA, 20 bp, Artificial sequence
  Synthetic Oligonucleotide
tccagcctctctcatgctat

SEQ ID NO: 2854 - DNA, 20 bp, Artificial sequence
  Synthetic Oligonucleotide
tgataactgacacagggccc

SEQ ID NO: 2855 - DNA, 20 bp, Artificial sequence
  Synthetic Oligonucleotide
ggcccttcatgctctccact

SEQ ID NO: 2856 - DNA, 20 bp, Artificial sequence
  Synthetic Oligonucleotide
agataaataaattggagggt

SEQ ID NO: 2857 - DNA, 20 bp, Artificial sequence
  Synthetic Oligonucleotide
atatttttaagcccacattg

SEQ ID NO: 2858 - DNA, 20 bp, Artificial sequence
  Synthetic Oligonucleotide
tcatcaacggcctcacaatc

SEQ ID NO: 2859 - DNA, 20 bp, Artificial sequence
  Synthetic Oligonucleotide
aattttgaataactctaata

SEQ ID NO: 2860 - DNA, 20 bp, Artificial sequence
  Synthetic Oligonucleotide
atgtcatgtgtgagtttaca

SEQ ID NO: 2861 - DNA, 20 bp, Artificial sequence
  Synthetic Oligonucleotide
ggtcttactcaatagtcacc

SEQ ID NO: 2862 - DNA, 20 bp, Artificial sequence
  Synthetic Oligonucleotide
acttatagatatgaaagcat

SEQ ID NO: 2863 - DNA, 20 bp, Artificial sequence
  Synthetic Oligonucleotide
aaagatttacatttagtcga

SEQ ID NO: 2864 - DNA, 20 bp, Artificial sequence
  Synthetic Oligonucleotide
atataactagagaaaatgat

SEQ ID NO: 2865 - DNA, 20 bp, Artificial sequence
  Synthetic Oligonucleotide
aagttctgtaaaggctatat

SEQ ID NO: 2866 - DNA, 20 bp, Artificial sequence
  Synthetic Oligonucleotide
aaagaaaagaaccaaggttt

SEQ ID NO: 2867 - DNA, 20 bp, Artificial sequence
  Synthetic Oligonucleotide
gcatttagtttgttgccaca

SEQ ID NO: 2868 - DNA, 20 bp, Artificial sequence
  Synthetic Oligonucleotide
ctaataaagtggatggattt

SEQ ID NO: 2869 - DNA, 20 bp, Artificial sequence
  Synthetic Oligonucleotide
tatcatcttaataatacata

SEQ ID NO: 2870 - DNA, 20 bp, Artificial sequence
  Synthetic Oligonucleotide
ctcttgaagaaaaactattt

SEQ ID NO: 2871 - DNA, 20 bp, Artificial sequence
  Synthetic Oligonucleotide
agaacaatcagatagatata

SEQ ID NO: 2872 - DNA, 20 bp, Artificial sequence
  Synthetic Oligonucleotide
tttgtggaaggaattttcct

SEQ ID NO: 2873 - DNA, 20 bp, Artificial sequence
  Synthetic Oligonucleotide
gtaccccttcaaaaagcttc

SEQ ID NO: 2874 - DNA, 20 bp, Artificial sequence
  Synthetic Oligonucleotide
cactatacccatatacccaa

SEQ ID NO: 2875 - DNA, 20 bp, Artificial sequence
  Synthetic Oligonucleotide
gaaaactgcatttcaccaag

SEQ ID NO: 2876 - DNA, 20 bp, Artificial sequence
  Synthetic Oligonucleotide
ttatccagaaaatctccaaa

SEQ ID NO: 2877 - DNA, 20 bp, Artificial sequence
  Synthetic Oligonucleotide
tccatagttccaaaacagac

SEQ ID NO: 2878 - DNA, 20 bp, Artificial sequence
  Synthetic Oligonucleotide
caaagatgctcctgaacatc

SEQ ID NO: 2879 - DNA, 20 bp, Artificial sequence
  Synthetic Oligonucleotide
cactgggaatagacagaaac

SEQ ID NO: 2880 - DNA, 20 bp, Artificial sequence
  Synthetic Oligonucleotide
ggttttgacaagtgtaccat

SEQ ID NO: 2881 - DNA, 20 bp, Artificial sequence
  Synthetic Oligonucleotide
accaatagtgtgtcacttaa

SEQ ID NO: 2882 - DNA, 20 bp, Artificial sequence
  Synthetic Oligonucleotide
actagcattattgacatatg

SEQ ID NO: 2883 - DNA, 20 bp, Artificial sequence
  Synthetic Oligonucleotide
tagtgagtgaacacagccat

SEQ ID NO: 2884 - DNA, 20 bp, Artificial sequence
  Synthetic Oligonucleotide
tcctgacacaagctttttaa

SEQ ID NO: 2885 - DNA, 20 bp, Artificial sequence
  Synthetic Oligonucleotide
ctggtatttctcaaagcatt

SEQ ID NO: 2886 - DNA, 20 bp, Artificial sequence
  Synthetic Oligonucleotide
ttttaaatattcaaggtaaa

SEQ ID NO: 2887 - DNA, 20 bp, Artificial sequence
  Synthetic Oligonucleotide
aatgtgcaacaaagaattat

SEQ ID NO: 2888 - DNA, 20 bp, Artificial sequence
  Synthetic Oligonucleotide
cattatcttgactttatcac

SEQ ID NO: 2889 - DNA, 20 bp, Artificial sequence
  Synthetic Oligonucleotide
tagcaattaattttttaagg

SEQ ID NO: 2890 - DNA, 20 bp, Artificial sequence
  Synthetic Oligonucleotide
agaagtaataaaacattttt

SEQ ID NO: 2891 - DNA, 20 bp, Artificial sequence
  Synthetic Oligonucleotide
gggagagtaatcacaaacat

SEQ ID NO: 2892 - DNA, 20 bp, Artificial sequence
  Synthetic Oligonucleotide
tctcctgttcagaaacaaat

SEQ ID NO: 2893 - DNA, 20 bp, Artificial sequence
  Synthetic Oligonucleotide
gtttagagcagtaagtcatg

SEQ ID NO: 2894 - DNA, 20 bp, Artificial sequence
  Synthetic Oligonucleotide
taaaatttgaaatgcatgct

SEQ ID NO: 2895 - DNA, 20 bp, Artificial sequence
  Synthetic Oligonucleotide
tacttaacgaagattaaata

SEQ ID NO: 2896 - DNA, 20 bp, Artificial sequence
  Synthetic Oligonucleotide
caaatgcatacttgctttcg

SEQ ID NO: 2897 - DNA, 20 bp, Artificial sequence
  Synthetic Oligonucleotide
aacagtgtaaagttttcatc

SEQ ID NO: 2898 - DNA, 20 bp, Artificial sequence
  Synthetic Oligonucleotide
agagttgcatatggtttagg

SEQ ID NO: 2899 - DNA, 20 bp, Artificial sequence
  Synthetic Oligonucleotide
ttctaaattctcatccagtg

SEQ ID NO: 2900 - DNA, 20 bp, Artificial sequence
  Synthetic Oligonucleotide
atgatcatctgtttaaggaa

SEQ ID NO: 2901 - DNA, 20 bp, Artificial sequence
  Synthetic Oligonucleotide
agcataaacaagaaggagaa

SEQ ID NO: 2902 - DNA, 20 bp, Artificial sequence
  Synthetic Oligonucleotide
agttttgcctatcaagatga

SEQ ID NO: 2903 - DNA, 20 bp, Artificial sequence
  Synthetic Oligonucleotide
cctaagcacccatgaatgaa

SEQ ID NO: 2904 - DNA, 20 bp, Artificial sequence
  Synthetic Oligonucleotide
aatctcttttgggagatgag

SEQ ID NO: 2905 - DNA, 20 bp, Artificial sequence
  Synthetic Oligonucleotide
taaccattctgaattgaata

SEQ ID NO: 2906 - DNA, 20 bp, Artificial sequence
  Synthetic Oligonucleotide
aattattatcaaaggaagac

SEQ ID NO: 2907 - DNA, 20 bp, Artificial sequence
  Synthetic Oligonucleotide
aatttatgaaacacataata

SEQ ID NO: 2908 - DNA, 20 bp, Artificial sequence
  Synthetic Oligonucleotide
acctgctgcacactcgcgac

SEQ ID NO: 2909 - DNA, 20 bp, Artificial sequence
  Synthetic Oligonucleotide
acttccacattattgcaagg

SEQ ID NO: 2910 - DNA, 20 bp, Artificial sequence
  Synthetic Oligonucleotide
cgctgagatctgcaatgctg

SEQ ID NO: 2911 - DNA, 20 bp, Artificial sequence
  Synthetic Oligonucleotide
agaatgtatatgcttctgca

SEQ ID NO: 2912 - DNA, 20 bp, Artificial sequence
  Synthetic Oligonucleotide
agcattttacagccactttc

SEQ ID NO: 2913 - DNA, 20 bp, Artificial sequence
  Synthetic Oligonucleotide
aagatgctgacaatttgagg

SEQ ID NO: 2914 - DNA, 20 bp, Artificial sequence
  Synthetic Oligonucleotide
atttagacagcacatcttca

SEQ ID NO: 2915 - DNA, 20 bp, Artificial sequence
  Synthetic Oligonucleotide
caaatgtgtcaaactcttca

SEQ ID NO: 2916 - DNA, 20 bp, Artificial sequence
  Synthetic Oligonucleotide
cagtgtgcgggacctggtag

SEQ ID NO: 2917 - DNA, 20 bp, Artificial sequence
  Synthetic Oligonucleotide
atttccccatttcattggga

SEQ ID NO: 2918 - DNA, 20 bp, Artificial sequence
  Synthetic Oligonucleotide
cgaagttttgccaaagcatc

SEQ ID NO: 2919 - DNA, 20 bp, Artificial sequence
  Synthetic Oligonucleotide
ttttggacaaccttccactt

SEQ ID NO: 2920 - DNA, 20 bp, Artificial sequence
  Synthetic Oligonucleotide
aaggcatttcatatagtcgg

SEQ ID NO: 2921 - DNA, 20 bp, Artificial sequence
  Synthetic Oligonucleotide
gagccttggttgatctggat

SEQ ID NO: 2922 - DNA, 20 bp, Artificial sequence
  Synthetic Oligonucleotide
tggctgagtggaggtatctc

SEQ ID NO: 2923 - DNA, 20 bp, Artificial sequence
  Synthetic Oligonucleotide
tttcaacaggaagatgcacc

SEQ ID NO: 2924 - DNA, 20 bp, Artificial sequence
  Synthetic Oligonucleotide
agctgtgctgtcatcatgac

SEQ ID NO: 2925 - DNA, 20 bp, Artificial sequence
  Synthetic Oligonucleotide
aaaaatatcacttgaaggac

SEQ ID NO: 2926 - DNA, 20 bp, Artificial sequence
  Synthetic Oligonucleotide
tttacctgctgcacactcgc

SEQ ID NO: 2927 - DNA, 20 bp, Artificial sequence
  Synthetic Oligonucleotide
tatacatgtatcaaatagca

SEQ ID NO: 2928 - DNA, 20 bp, Artificial sequence
  Synthetic Oligonucleotide
atctctctaagagagaaggt

SEQ ID NO: 2929 - DNA, 20 bp, Artificial sequence
  Synthetic Oligonucleotide
tctcttcatggtttgaattc

SEQ ID NO: 2930 - DNA, 20 bp, Artificial sequence
  Synthetic Oligonucleotide
aagtttgcttatttgcattt

SEQ ID NO: 2931 - DNA, 20 bp, Artificial sequence
  Synthetic Oligonucleotide
taatttcatgagtctcaatc

SEQ ID NO: 2932 - DNA, 20 bp, Artificial sequence
  Synthetic Oligonucleotide
catgtataaaattatagttt

SEQ ID NO: 2933 - DNA, 20 bp, Artificial sequence
  Synthetic Oligonucleotide
caatgtgggtggaaaacaat

SEQ ID NO: 2934 - DNA, 20 bp, Artificial sequence
  Synthetic Oligonucleotide
atagacaatgacccttgctc

SEQ ID NO: 2935 - DNA, 20 bp, Artificial sequence
  Synthetic Oligonucleotide
ttctcatgaaaaataatgaa

SEQ ID NO: 2936 - DNA, 20 bp, Artificial sequence
  Synthetic Oligonucleotide
tgagctacacaggacagaaa

SEQ ID NO: 2937 - DNA, 20 bp, Artificial sequence
  Synthetic Oligonucleotide
caaaagcatatgcagcagag

SEQ ID NO: 2938 - DNA, 20 bp, Artificial sequence
  Synthetic Oligonucleotide
atcaaaggagatttccaggt

SEQ ID NO: 2939 - DNA, 20 bp, Artificial sequence
  Synthetic Oligonucleotide
aataagtagtctatcttaag

SEQ ID NO: 2940 - DNA, 20 bp, Artificial sequence
  Synthetic Oligonucleotide
tccgctgtgtttttgcctca

SEQ ID NO: 2941 - DNA, 20 bp, Artificial sequence
  Synthetic Oligonucleotide
atgcctcactcacccccgac

SEQ ID NO: 2942 - DNA, 20 bp, Artificial sequence
  Synthetic Oligonucleotide
aagaagatgtgaccactaaa

SEQ ID NO: 2943 - DNA, 20 bp, Artificial sequence
  Synthetic Oligonucleotide
gtaattcccttcttctcttt

SEQ ID NO: 2944 - DNA, 20 bp, Artificial sequence
  Synthetic Oligonucleotide
aatactattgttatttttac

SEQ ID NO: 2945 - DNA, 20 bp, Artificial sequence
  Synthetic Oligonucleotide
cagggtgcatagtctgtagg

SEQ ID NO: 2946 - DNA, 20 bp, Artificial sequence
  Synthetic Oligonucleotide
tctgaactttctgtttgatt

SEQ ID NO: 2947 - DNA, 20 bp, Artificial sequence
  Synthetic Oligonucleotide
gccctacaaaaatctattct

SEQ ID NO: 2948 - DNA, 20 bp, Artificial sequence
  Synthetic Oligonucleotide
ggatgcaagtgaaaaacact

SEQ ID NO: 2949 - DNA, 20 bp, Artificial sequence
  Synthetic Oligonucleotide
ctagatataaataacctctg

SEQ ID NO: 2950 - DNA, 20 bp, Artificial sequence
  Synthetic Oligonucleotide
ataatatccatcagttactg

SEQ ID NO: 2951 - DNA, 20 bp, Artificial sequence
  Synthetic Oligonucleotide
gaagagacagccaggtgaag

SEQ ID NO: 2952 - DNA, 20 bp, Artificial sequence
  Synthetic Oligonucleotide
acaatattttggaacaactc

SEQ ID NO: 2953 - DNA, 20 bp, Artificial sequence
  Synthetic Oligonucleotide
ataggtaatatgatttaatt

SEQ ID NO: 2954 - DNA, 20 bp, Artificial sequence
  Synthetic Oligonucleotide
tcatgtttcatggtttcttt

SEQ ID NO: 2955 - DNA, 20 bp, Artificial sequence
  Synthetic Oligonucleotide
ggaaggaaccatgaaatttt

SEQ ID NO: 2956 - DNA, 20 bp, Artificial sequence
  Synthetic Oligonucleotide
ccttgagaatttaacaattt

SEQ ID NO: 2957 - DNA, 20 bp, Artificial sequence
  Synthetic Oligonucleotide
ctctttcttacccttctaaa

SEQ ID NO: 2958 - DNA, 20 bp, Artificial sequence
  Synthetic Oligonucleotide
gcaaagcaaacagattttga

SEQ ID NO: 2959 - DNA, 20 bp, Artificial sequence
  Synthetic Oligonucleotide
tcactcatctgtaatattaa

SEQ ID NO: 2960 - DNA, 20 bp, Artificial sequence
  Synthetic Oligonucleotide
ctaacatatccctccatgtt

SEQ ID NO: 2961 - DNA, 20 bp, Artificial sequence
  Synthetic Oligonucleotide
ccataaaacaggaattccaa

SEQ ID NO: 2962 - DNA, 20 bp, Artificial sequence
  Synthetic Oligonucleotide
atctcttaacccagagaatt

SEQ ID NO: 2963 - DNA, 20 bp, Artificial sequence
  Synthetic Oligonucleotide
atatttgagacactgacatg

SEQ ID NO: 2964 - DNA, 20 bp, Artificial sequence
  Synthetic Oligonucleotide
aattactccacagaatcttc

SEQ ID NO: 2965 - DNA, 20 bp, Artificial sequence
  Synthetic Oligonucleotide
aattctaactctacctcttc

SEQ ID NO: 2966 - DNA, 20 bp, Artificial sequence
  Synthetic Oligonucleotide
taaaaagaagtttttgatca

SEQ ID NO: 2967 - DNA, 20 bp, Artificial sequence
  Synthetic Oligonucleotide
atgtgcaggaagtcaagata

SEQ ID NO: 2968 - DNA, 20 bp, Artificial sequence
  Synthetic Oligonucleotide
gtattatttgcatcttatca

SEQ ID NO: 2969 - DNA, 20 bp, Artificial sequence
  Synthetic Oligonucleotide
agtgagtcttacaaaaagtt

SEQ ID NO: 2970 - DNA, 20 bp, Artificial sequence
  Synthetic Oligonucleotide
gagaaaagcacagatgactc

SEQ ID NO: 2971 - DNA, 20 bp, Artificial sequence
  Synthetic Oligonucleotide
ctctgcaattcaaaaaaagt

SEQ ID NO: 2972 - DNA, 20 bp, Artificial sequence
  Synthetic Oligonucleotide
taggcaatgagagatgatac

SEQ ID NO: 2973 - DNA, 20 bp, Artificial sequence
  Synthetic Oligonucleotide
cagctgaagattctctctct

SEQ ID NO: 2974 - DNA, 20 bp, Artificial sequence
  Synthetic Oligonucleotide
tcaggattgggaactaagaa

SEQ ID NO: 2975 - DNA, 20 bp, Artificial sequence
  Synthetic Oligonucleotide
ttctctaaactttagtctct

SEQ ID NO: 2976 - DNA, 20 bp, Artificial sequence
  Synthetic Oligonucleotide
tactctttcaactgttcttt

SEQ ID NO: 2977 - DNA, 20 bp, Artificial sequence
  Synthetic Oligonucleotide
ggatggtgaaaattatagga

SEQ ID NO: 2978 - DNA, 20 bp, Artificial sequence
  Synthetic Oligonucleotide
ttctatattgcagagccacc

SEQ ID NO: 2979 - DNA, 20 bp, Artificial sequence
  Synthetic Oligonucleotide
ttcagtggagtttagttcag

SEQ ID NO: 2980 - DNA, 20 bp, Artificial sequence
  Synthetic Oligonucleotide
ccaagttcacaaaaccaata

SEQ ID NO: 2981 - DNA, 20 bp, Artificial sequence
  Synthetic Oligonucleotide
atggcaaactcctacttggc

SEQ ID NO: 2982 - DNA, 20 bp, Artificial sequence
  Synthetic Oligonucleotide
ttttcccagaaccagtgaat

SEQ ID NO: 2983 - DNA, 20 bp, Artificial sequence
  Synthetic Oligonucleotide
tttggatatggtaaggtaca

SEQ ID NO: 2984 - DNA, 20 bp, Artificial sequence
  Synthetic Oligonucleotide
tgctgcacactcgcgactct

SEQ ID NO: 2985 - DNA, 20 bp, Artificial sequence
  Synthetic Oligonucleotide
tcgctagggaatgtaaacaa

SEQ ID NO: 2986 - DNA, 20 bp, Artificial sequence
  Synthetic Oligonucleotide
ctttcatagcttccaccaca

SEQ ID NO: 2987 - DNA, 20 bp, Artificial sequence
  Synthetic Oligonucleotide
gcattaactccaaaacattc

SEQ ID NO: 2988 - DNA, 20 bp, Artificial sequence
  Synthetic Oligonucleotide
acagccactttcagccactt

SEQ ID NO: 2989 - DNA, 20 bp, Artificial sequence
  Synthetic Oligonucleotide
cattcttctttgtaatcaag

SEQ ID NO: 2990 - DNA, 20 bp, Artificial sequence
  Synthetic Oligonucleotide
gctagtgtagatgctatatt

SEQ ID NO: 2991 - DNA, 20 bp, Artificial sequence
  Synthetic Oligonucleotide
gtcaaactcttcagagtttc

SEQ ID NO: 2992 - DNA, 20 bp, Artificial sequence
  Synthetic Oligonucleotide
ggaaaatttgttctgagata

SEQ ID NO: 2993 - DNA, 20 bp, Artificial sequence
  Synthetic Oligonucleotide
atccagagatgtcagatttt

SEQ ID NO: 2994 - DNA, 20 bp, Artificial sequence
  Synthetic Oligonucleotide
gcgcgagcctttatattgaa

SEQ ID NO: 2995 - DNA, 20 bp, Artificial sequence
  Synthetic Oligonucleotide
catttcatatagtcggatga

SEQ ID NO: 2996 - DNA, 20 bp, Artificial sequence
  Synthetic Oligonucleotide
ttgatgttcttcaccatcat

SEQ ID NO: 2997 - DNA, 20 bp, Artificial sequence
  Synthetic Oligonucleotide
tgctgaagcaggcgatccaa

SEQ ID NO: 2998 - DNA, 20 bp, Artificial sequence
  Synthetic Oligonucleotide
tcaagaaatgagagctgtcc

SEQ ID NO: 2999 - DNA, 20 bp, Artificial sequence
  Synthetic Oligonucleotide
tcctccagttcctatccaaa

SEQ ID NO: 3000 - DNA, 20 bp, Artificial sequence
  Synthetic Oligonucleotide
atgtctaggaaagacacaga

SEQ ID NO: 3001 - DNA, 20 bp, Artificial sequence
  Synthetic Oligonucleotide
atttaaatatggtattcatt

SEQ ID NO: 3002 - DNA, 20 bp, Artificial sequence
  Synthetic Oligonucleotide
actcataactactccggaca

SEQ ID NO: 3003 - DNA, 20 bp, Artificial sequence
  Synthetic Oligonucleotide
tggcagtctggaatatcatg

SEQ ID NO: 3004 - DNA, 20 bp, Artificial sequence
  Synthetic Oligonucleotide
aatcaaacttctgagtttaa

SEQ ID NO: 3005 - DNA, 20 bp, Artificial sequence
  Synthetic Oligonucleotide
agcactacttattttccaat

SEQ ID NO: 3006 - DNA, 20 bp, Artificial sequence
  Synthetic Oligonucleotide
aggcaccttcattcctattg

SEQ ID NO: 3007 - DNA, 20 bp, Artificial sequence
  Synthetic Oligonucleotide
ttttaattttatgccagagt

SEQ ID NO: 3008 - DNA, 20 bp, Artificial sequence
  Synthetic Oligonucleotide
ttgtgattttataaacatca

SEQ ID NO: 3009 - DNA, 20 bp, Artificial sequence
  Synthetic Oligonucleotide
ttaacccttatttatatatg

SEQ ID NO: 3010 - DNA, 20 bp, Artificial sequence
  Synthetic Oligonucleotide
ttatatacatctgtgtataa

SEQ ID NO: 3011 - DNA, 20 bp, Artificial sequence
  Synthetic Oligonucleotide
ttaacatataacactattta

SEQ ID NO: 3012 - DNA, 20 bp, Artificial sequence
  Synthetic Oligonucleotide
cagaggatacccattgcaaa

SEQ ID NO: 3013 - DNA, 20 bp, Artificial sequence
  Synthetic Oligonucleotide
cctctttaactgcacagtag

SEQ ID NO: 3014 - DNA, 20 bp, Artificial sequence
  Synthetic Oligonucleotide
aacctttcccaaagtggcta

SEQ ID NO: 3015 - DNA, 20 bp, Artificial sequence
  Synthetic Oligonucleotide
taaccctacttcttacaagt

SEQ ID NO: 3016 - DNA, 20 bp, Artificial sequence
  Synthetic Oligonucleotide
catcgatattctcaaagcct

SEQ ID NO: 3017 - DNA, 20 bp, Artificial sequence
  Synthetic Oligonucleotide
tacttaaaatacttcaaaca

SEQ ID NO: 3018 - DNA, 20 bp, Artificial sequence
  Synthetic Oligonucleotide
accatatactatgagaccag

SEQ ID NO: 3019 - DNA, 20 bp, Artificial sequence
  Synthetic Oligonucleotide
ggaattacagtggagaggtt

SEQ ID NO: 3020 - DNA, 20 bp, Artificial sequence
  Synthetic Oligonucleotide
gtgcatagtctgtaggtagt

SEQ ID NO: 3021 - DNA, 20 bp, Artificial sequence
  Synthetic Oligonucleotide
gctctgttgtcacccttgta

SEQ ID NO: 3022 - DNA, 20 bp, Artificial sequence
  Synthetic Oligonucleotide
cattagaagatgaattcact

SEQ ID NO: 3023 - DNA, 20 bp, Artificial sequence
  Synthetic Oligonucleotide
ataatattgaacagtaggtt

SEQ ID NO: 3024 - DNA, 20 bp, Artificial sequence
  Synthetic Oligonucleotide
ctgttgggtagaaagatttg

SEQ ID NO: 3025 - DNA, 20 bp, Artificial sequence
  Synthetic Oligonucleotide
ggttggaaggcaccaattaa

SEQ ID NO: 3026 - DNA, 20 bp, Artificial sequence
  Synthetic Oligonucleotide
agcctactgagcggttggaa

SEQ ID NO: 3027 - DNA, 20 bp, Artificial sequence
  Synthetic Oligonucleotide
gttgcagacattttacatac

SEQ ID NO: 3028 - DNA, 20 bp, Artificial sequence
  Synthetic Oligonucleotide
tagaaccatacctaaatagt

SEQ ID NO: 3029 - DNA, 20 bp, Artificial sequence
  Synthetic Oligonucleotide
gtaatacccgaaagaaggga

SEQ ID NO: 3030 - DNA, 20 bp, Artificial sequence
  Synthetic Oligonucleotide
tgaaaaagctatatccatat

SEQ ID NO: 3031 - DNA, 20 bp, Artificial sequence
  Synthetic Oligonucleotide
aaaaaaaactttcagtaatc

SEQ ID NO: 3032 - DNA, 20 bp, Artificial sequence
  Synthetic Oligonucleotide
aacacaatccacaacagaat

SEQ ID NO: 3033 - DNA, 20 bp, Artificial sequence
  Synthetic Oligonucleotide
aggaggaaaatactatccaa

SEQ ID NO: 3034 - DNA, 20 bp, Artificial sequence
  Synthetic Oligonucleotide
tatatgcacagttttgctga

SEQ ID NO: 3035 - DNA, 20 bp, Artificial sequence
  Synthetic Oligonucleotide
agaacagaaagctcagtttt

SEQ ID NO: 3036 - DNA, 20 bp, Artificial sequence
  Synthetic Oligonucleotide
ctctcagaaacattttctca

SEQ ID NO: 3037 - DNA, 20 bp, Artificial sequence
  Synthetic Oligonucleotide
aacaaaacttaaaagtgtct

SEQ ID NO: 3038 - DNA, 20 bp, Artificial sequence
  Synthetic Oligonucleotide
aaacaactcacacatttcta

SEQ ID NO: 3039 - DNA, 20 bp, Artificial sequence
  Synthetic Oligonucleotide
agttgagttacctcctgata

SEQ ID NO: 3040 - DNA, 20 bp, Artificial sequence
  Synthetic Oligonucleotide
tctggttactagaatgtagc

SEQ ID NO: 3041 - DNA, 20 bp, Artificial sequence
  Synthetic Oligonucleotide
gattgcctactccaaggttt

SEQ ID NO: 3042 - DNA, 20 bp, Artificial sequence
  Synthetic Oligonucleotide
aggcttttaatgaatatttc

SEQ ID NO: 3043 - DNA, 20 bp, Artificial sequence
  Synthetic Oligonucleotide
ggtattgagagagcttcaga

SEQ ID NO: 3044 - DNA, 20 bp, Artificial sequence
  Synthetic Oligonucleotide
gaaaagacaaactaggattg

SEQ ID NO: 3045 - DNA, 20 bp, Artificial sequence
  Synthetic Oligonucleotide
gtagaacagagtctgaagta

SEQ ID NO: 3046 - DNA, 20 bp, Artificial sequence
  Synthetic Oligonucleotide
ctgtaactctgttgaaatgt

SEQ ID NO: 3047 - DNA, 20 bp, Artificial sequence
  Synthetic Oligonucleotide
tcaaagaccacagcctttcc

SEQ ID NO: 3048 - DNA, 20 bp, Artificial sequence
  Synthetic Oligonucleotide
gctaagagacttctttcttc

SEQ ID NO: 3049 - DNA, 20 bp, Artificial sequence
  Synthetic Oligonucleotide
actaaagtttttgctgttac

SEQ ID NO: 3050 - DNA, 20 bp, Artificial sequence
  Synthetic Oligonucleotide
cggaaaagacaagaagataa

SEQ ID NO: 3051 - DNA, 20 bp, Artificial sequence
  Synthetic Oligonucleotide
ttatcatgtgaattagcata

SEQ ID NO: 3052 - DNA, 20 bp, Artificial sequence
  Synthetic Oligonucleotide
ccagacattgcaaagaaaaa

SEQ ID NO: 3053 - DNA, 20 bp, Artificial sequence
  Synthetic Oligonucleotide
agtgtgaaggcaccgtaaga

SEQ ID NO: 3054 - DNA, 20 bp, Artificial sequence
  Synthetic Oligonucleotide
ccaattccatccattgaaat

SEQ ID NO: 3055 - DNA, 20 bp, Artificial sequence
  Synthetic Oligonucleotide
aaaagtgattaggttgagtg

SEQ ID NO: 3056 - DNA, 20 bp, Artificial sequence
  Synthetic Oligonucleotide
tattttctacatacccctcg

SEQ ID NO: 3057 - DNA, 20 bp, Artificial sequence
  Synthetic Oligonucleotide
atctaaaatgttctcaagag

SEQ ID NO: 3058 - DNA, 20 bp, Artificial sequence
  Synthetic Oligonucleotide
gttggcttctcagaggtttt

SEQ ID NO: 3059 - DNA, 20 bp, Artificial sequence
  Synthetic Oligonucleotide
gaggacttccacattattgc

SEQ ID NO: 3060 - DNA, 20 bp, Artificial sequence
  Synthetic Oligonucleotide
tctcattcttttcctctaaa

SEQ ID NO: 3061 - DNA, 20 bp, Artificial sequence
  Synthetic Oligonucleotide
caggagaatgtatatgcttc

SEQ ID NO: 3062 - DNA, 20 bp, Artificial sequence
  Synthetic Oligonucleotide
cgtttcataactgttagtat

SEQ ID NO: 3063 - DNA, 20 bp, Artificial sequence
  Synthetic Oligonucleotide
catccatagctacttttgca

SEQ ID NO: 3064 - DNA, 20 bp, Artificial sequence
  Synthetic Oligonucleotide
attctcctacactaattgaa

SEQ ID NO: 3065 - DNA, 20 bp, Artificial sequence
  Synthetic Oligonucleotide
gtccaaatgtgtcaaactct

SEQ ID NO: 3066 - DNA, 20 bp, Artificial sequence
  Synthetic Oligonucleotide
atctgattatggctaaataa

SEQ ID NO: 3067 - DNA, 20 bp, Artificial sequence
  Synthetic Oligonucleotide
tggctttacatcctatatgt

SEQ ID NO: 3068 - DNA, 20 bp, Artificial sequence
  Synthetic Oligonucleotide
aagttctacatagcagtctg

SEQ ID NO: 3069 - DNA, 20 bp, Artificial sequence
  Synthetic Oligonucleotide
gtgacatgtagttctttgga

SEQ ID NO: 3070 - DNA, 20 bp, Artificial sequence
  Synthetic Oligonucleotide
aaataaggcatttcatatag

SEQ ID NO: 3071 - DNA, 20 bp, Artificial sequence
  Synthetic Oligonucleotide
tggtgagccttggttgatct

SEQ ID NO: 3072 - DNA, 20 bp, Artificial sequence
  Synthetic Oligonucleotide
tagtcagcaatctttgcaat

SEQ ID NO: 3073 - DNA, 20 bp, Artificial sequence
  Synthetic Oligonucleotide
atgaccaggagagtaccaga

SEQ ID NO: 3074 - DNA, 20 bp, Artificial sequence
  Synthetic Oligonucleotide
ttttccggttgtagcccaat

SEQ ID NO: 3075 - DNA, 20 bp, Artificial sequence
  Synthetic Oligonucleotide
tgtaggatctgcagcatcac

SEQ ID NO: 3076 - DNA, 20 bp, Artificial sequence
  Synthetic Oligonucleotide
acaatgcctttacctgctgc

SEQ ID NO: 3077 - DNA, 20 bp, Artificial sequence
  Synthetic Oligonucleotide
tacttcagcccaggattgca

SEQ ID NO: 3078 - DNA, 20 bp, Artificial sequence
  Synthetic Oligonucleotide
ctacatggaacttctgtgat

SEQ ID NO: 3079 - DNA, 20 bp, Artificial sequence
  Synthetic Oligonucleotide
cagatgtgctgaaagttaat

SEQ ID NO: 3080 - DNA, 20 bp, Artificial sequence
  Synthetic Oligonucleotide
atgagatttttgagaggcaa

SEQ ID NO: 3081 - DNA, 20 bp, Artificial sequence
  Synthetic Oligonucleotide
aatttttacatgaagactgt

SEQ ID NO: 3082 - DNA, 20 bp, Artificial sequence
  Synthetic Oligonucleotide
ctagagaaaactgacagtga

SEQ ID NO: 3083 - DNA, 20 bp, Artificial sequence
  Synthetic Oligonucleotide
aaagactctaccagaaaaag

SEQ ID NO: 3084 - DNA, 20 bp, Artificial sequence
  Synthetic Oligonucleotide
aatgtatggtgacttgacct

SEQ ID NO: 3085 - DNA, 20 bp, Artificial sequence
  Synthetic Oligonucleotide
aacaaaaccacttcttcttc

SEQ ID NO: 3086 - DNA, 20 bp, Artificial sequence
  Synthetic Oligonucleotide
tgaagagaaaaccacacact

SEQ ID NO: 3087 - DNA, 20 bp, Artificial sequence
  Synthetic Oligonucleotide
ttatagttcattttttaaga

SEQ ID NO: 3088 - DNA, 20 bp, Artificial sequence
  Synthetic Oligonucleotide
actccaaagacaatacaaaa

SEQ ID NO: 3089 - DNA, 20 bp, Artificial sequence
  Synthetic Oligonucleotide
caactggccaattttcctct

SEQ ID NO: 3090 - DNA, 20 bp, Artificial sequence
  Synthetic Oligonucleotide
gatacattccttcttttcca

SEQ ID NO: 3091 - DNA, 20 bp, Artificial sequence
  Synthetic Oligonucleotide
ccttttctttgggcctcagc

SEQ ID NO: 3092 - DNA, 20 bp, Artificial sequence
  Synthetic Oligonucleotide
acttctgaggctgcctatta

SEQ ID NO: 3093 - DNA, 20 bp, Artificial sequence
  Synthetic Oligonucleotide
ccaattcatcttatgcaaaa

SEQ ID NO: 3094 - DNA, 20 bp, Artificial sequence
  Synthetic Oligonucleotide
atttcctgagccacccttct

SEQ ID NO: 3095 - DNA, 20 bp, Artificial sequence
  Synthetic Oligonucleotide
attaagtacttgtccagggt

SEQ ID NO: 3096 - DNA, 20 bp, Artificial sequence
  Synthetic Oligonucleotide
gacacagagagctgtgagca

SEQ ID NO: 3097 - DNA, 20 bp, Artificial sequence
  Synthetic Oligonucleotide
gaataaccatgctgacttta

SEQ ID NO: 3098 - DNA, 20 bp, Artificial sequence
  Synthetic Oligonucleotide
aagacacaaacaattgcaat

SEQ ID NO: 3099 - DNA, 20 bp, Artificial sequence
  Synthetic Oligonucleotide
tgatagaagtgtttggtttt

SEQ ID NO: 3100 - DNA, 20 bp, Artificial sequence
  Synthetic Oligonucleotide
ggttagcatgtgaggtgcca

SEQ ID NO: 3101 - DNA, 20 bp, Artificial sequence
  Synthetic Oligonucleotide
aaggttacaaccatgaacaa

SEQ ID NO: 3102 - DNA, 20 bp, Artificial sequence
  Synthetic Oligonucleotide
atattgcataacttaatagc

SEQ ID NO: 3103 - DNA, 20 bp, Artificial sequence
  Synthetic Oligonucleotide
agagcatttttcaacaccta

SEQ ID NO: 3104 - DNA, 20 bp, Artificial sequence
  Synthetic Oligonucleotide
atagtccagcaggaaaaagc

SEQ ID NO: 3105 - DNA, 20 bp, Artificial sequence
  Synthetic Oligonucleotide
tgaataattggaggaaattc

SEQ ID NO: 3106 - DNA, 20 bp, Artificial sequence
  Synthetic Oligonucleotide
ctctgtctccagatataaaa

SEQ ID NO: 3107 - DNA, 20 bp, Artificial sequence
  Synthetic Oligonucleotide
aattagttgtaaaaatgtaa

SEQ ID NO: 3108 - DNA, 20 bp, Artificial sequence
  Synthetic Oligonucleotide
caggacactcctagaagctg

SEQ ID NO: 3109 - DNA, 20 bp, Artificial sequence
  Synthetic Oligonucleotide
tgctatatgaaatacagtgt

SEQ ID NO: 3110 - DNA, 20 bp, Artificial sequence
  Synthetic Oligonucleotide
gaccatgtttagagaactat

SEQ ID NO: 3111 - DNA, 20 bp, Artificial sequence
  Synthetic Oligonucleotide
ttacatgacattaccatcta

SEQ ID NO: 3112 - DNA, 20 bp, Artificial sequence
  Synthetic Oligonucleotide
cagaatttctgcttaaattc

SEQ ID NO: 3113 - DNA, 20 bp, Artificial sequence
  Synthetic Oligonucleotide
gaaacatggaatctagaaca

SEQ ID NO: 3114 - DNA, 20 bp, Artificial sequence
  Synthetic Oligonucleotide
caaattaacttaatttttac

SEQ ID NO: 3115 - DNA, 20 bp, Artificial sequence
  Synthetic Oligonucleotide
gcccaaggacttgtcttacc

SEQ ID NO: 3116 - DNA, 20 bp, Artificial sequence
  Synthetic Oligonucleotide
gtatcaaaacataccttcct

SEQ ID NO: 3117 - DNA, 20 bp, Artificial sequence
  Synthetic Oligonucleotide
ttctcaccacataaatattt

SEQ ID NO: 3118 - DNA, 20 bp, Artificial sequence
  Synthetic Oligonucleotide
ccttgaaatgtagtcacttg

SEQ ID NO: 3119 - DNA, 20 bp, Artificial sequence
  Synthetic Oligonucleotide
acagaaggcgaagtcaggag

SEQ ID NO: 3120 - DNA, 20 bp, Artificial sequence
  Synthetic Oligonucleotide
ggccacagtgatcagtttgg

SEQ ID NO: 3121 - DNA, 20 bp, Artificial sequence
  Synthetic Oligonucleotide
aaaaaatacatatcatcccc

SEQ ID NO: 3122 - DNA, 20 bp, Artificial sequence
  Synthetic Oligonucleotide
ataatcctttataataagta

SEQ ID NO: 3123 - DNA, 20 bp, Artificial sequence
  Synthetic Oligonucleotide
cacaagacttaatggagtta

SEQ ID NO: 3124 - DNA, 20 bp, Artificial sequence
  Synthetic Oligonucleotide
aacaaatgccaacccctaaa

SEQ ID NO: 3125 - DNA, 20 bp, Artificial sequence
  Synthetic Oligonucleotide
tatagtatttatatgggtgt

SEQ ID NO: 3126 - DNA, 20 bp, Artificial sequence
  Synthetic Oligonucleotide
acaaagggaaatggttaaac

SEQ ID NO: 3127 - DNA, 20 bp, Artificial sequence
  Synthetic Oligonucleotide
acgggcaccctacaagaaat

SEQ ID NO: 3128 - DNA, 20 bp, Artificial sequence
  Synthetic Oligonucleotide
agtaactttccaaatggtat

SEQ ID NO: 3129 - DNA, 20 bp, Artificial sequence
  Synthetic Oligonucleotide
ctctgccccttttcccagac

SEQ ID NO: 3130 - DNA, 20 bp, Artificial sequence
  Synthetic Oligonucleotide
ttaccaggtgctggtcatta

SEQ ID NO: 3131 - DNA, 20 bp, Artificial sequence
  Synthetic Oligonucleotide
ataaagaaaaattacgaaca

SEQ ID NO: 3132 - DNA, 20 bp, Artificial sequence
  Synthetic Oligonucleotide
tttaccattacctccctaga

SEQ ID NO: 3133 - DNA, 20 bp, Artificial sequence
  Synthetic Oligonucleotide
cagcttaacctttctataaa

SEQ ID NO: 3134 - DNA, 20 bp, Artificial sequence
  Synthetic Oligonucleotide
tgattttacctgaagttagg

SEQ ID NO: 3135 - DNA, 20 bp, Artificial sequence
  Synthetic Oligonucleotide
tcatgaggacttccacatta

SEQ ID NO: 3136 - DNA, 20 bp, Artificial sequence
  Synthetic Oligonucleotide
gattatttagtgcccagcat

SEQ ID NO: 3137 - DNA, 20 bp, Artificial sequence
  Synthetic Oligonucleotide
acttcaggagaatgtatatg

SEQ ID NO: 3138 - DNA, 20 bp, Artificial sequence
  Synthetic Oligonucleotide
atgaaattctgtatcctccc

SEQ ID NO: 3139 - DNA, 20 bp, Artificial sequence
  Synthetic Oligonucleotide
gcatctgctcccaatagaag

SEQ ID NO: 3140 - DNA, 20 bp, Artificial sequence
  Synthetic Oligonucleotide
ctgtaatacggcatctcggt

SEQ ID NO: 3141 - DNA, 20 bp, Artificial sequence
  Synthetic Oligonucleotide
gtgcaagtccaaatgtgtca

SEQ ID NO: 3142 - DNA, 20 bp, Artificial sequence
  Synthetic Oligonucleotide
atgctgatctgattatggct

SEQ ID NO: 3143 - DNA, 20 bp, Artificial sequence
  Synthetic Oligonucleotide
tggcacatttttacgctccg

SEQ ID NO: 3144 - DNA, 20 bp, Artificial sequence
  Synthetic Oligonucleotide
atactgtgacatgtagttct

SEQ ID NO: 3145 - DNA, 20 bp, Artificial sequence
  Synthetic Oligonucleotide
agaatacagccttttctaca

SEQ ID NO: 3146 - DNA, 20 bp, Artificial sequence
  Synthetic Oligonucleotide
tggaatggtgagccttggtt

SEQ ID NO: 3147 - DNA, 20 bp, Artificial sequence
  Synthetic Oligonucleotide
aatgacatttcctctggcaa

SEQ ID NO: 3148 - DNA, 20 bp, Artificial sequence
  Synthetic Oligonucleotide
ttgcttggaaaaggaattgc

SEQ ID NO: 3149 - DNA, 20 bp, Artificial sequence
  Synthetic Oligonucleotide
aataaatatttacaagagga

SEQ ID NO: 3150 - DNA, 20 bp, Artificial sequence
  Synthetic Oligonucleotide
gctatgtaaacaatttaagt

SEQ ID NO: 3151 - DNA, 20 bp, Artificial sequence
  Synthetic Oligonucleotide
attgggaagatacttggaat

SEQ ID NO: 3152 - DNA, 20 bp, Artificial sequence
  Synthetic Oligonucleotide
acacaaatcatttcaaaatg

SEQ ID NO: 3153 - DNA, 20 bp, Artificial sequence
  Synthetic Oligonucleotide
ggcacaagtttcttactcgc

SEQ ID NO: 3154 - DNA, 20 bp, Artificial sequence
  Synthetic Oligonucleotide
tctaatttgtctaaatttat

SEQ ID NO: 3155 - DNA, 20 bp, Artificial sequence
  Synthetic Oligonucleotide
ctctgcacttcagtgtttgt

SEQ ID NO: 3156 - DNA, 20 bp, Artificial sequence
  Synthetic Oligonucleotide
atctcagttatcaatctcag

SEQ ID NO: 3157 - DNA, 20 bp, Artificial sequence
  Synthetic Oligonucleotide
ataaccccacacctttactg

SEQ ID NO: 3158 - DNA, 20 bp, Artificial sequence
  Synthetic Oligonucleotide
cgaggctcaaccccattgga

SEQ ID NO: 3159 - DNA, 20 bp, Artificial sequence
  Synthetic Oligonucleotide
tatataattgctaggtagag

SEQ ID NO: 3160 - DNA, 20 bp, Artificial sequence
  Synthetic Oligonucleotide
tcattcagctacttttgaaa

SEQ ID NO: 3161 - DNA, 20 bp, Artificial sequence
  Synthetic Oligonucleotide
accaacagaatgaggtgtgc

SEQ ID NO: 3162 - DNA, 20 bp, Artificial sequence
  Synthetic Oligonucleotide
attcaaacaaaatgttagta

SEQ ID NO: 3163 - DNA, 20 bp, Artificial sequence
  Synthetic Oligonucleotide
actcaatagtcaccttcttt

SEQ ID NO: 3164 - DNA, 20 bp, Artificial sequence
  Synthetic Oligonucleotide
atgtggaggtatcgaccatt

SEQ ID NO: 3165 - DNA, 20 bp, Artificial sequence
  Synthetic Oligonucleotide
cgggaattatttcacttcat

SEQ ID NO: 3166 - DNA, 20 bp, Artificial sequence
  Synthetic Oligonucleotide
ccttgtatctagtctctctc

SEQ ID NO: 3167 - DNA, 20 bp, Artificial sequence
  Synthetic Oligonucleotide
ctacaagtcaaaaatgtggt

SEQ ID NO: 3168 - DNA, 20 bp, Artificial sequence
  Synthetic Oligonucleotide
atcatttccattaattattt

SEQ ID NO: 3169 - DNA, 20 bp, Artificial sequence
  Synthetic Oligonucleotide
cttagaatgaaattgctgat

SEQ ID NO: 3170 - DNA, 20 bp, Artificial sequence
  Synthetic Oligonucleotide
tgccaatgtggagttaattt

SEQ ID NO: 3171 - DNA, 20 bp, Artificial sequence
  Synthetic Oligonucleotide
taattattctcagtctttaa

SEQ ID NO: 3172 - DNA, 20 bp, Artificial sequence
  Synthetic Oligonucleotide
tcttagcacattctctgaac

SEQ ID NO: 3173 - DNA, 20 bp, Artificial sequence
  Synthetic Oligonucleotide
gacacatttgaaaagttatt

SEQ ID NO: 3174 - DNA, 20 bp, Artificial sequence
  Synthetic Oligonucleotide
tctttagaatattcacacat

SEQ ID NO: 3175 - DNA, 20 bp, Artificial sequence
  Synthetic Oligonucleotide
actggcaaatcaaacttcat

SEQ ID NO: 3176 - DNA, 20 bp, Artificial sequence
  Synthetic Oligonucleotide
aatgtaatctttatcaggac

SEQ ID NO: 3177 - DNA, 20 bp, Artificial sequence
  Synthetic Oligonucleotide
ttggaaaacagacacaaaag

SEQ ID NO: 3178 - DNA, 20 bp, Artificial sequence
  Synthetic Oligonucleotide
ggcctttgctggtgaagtct

SEQ ID NO: 3179 - DNA, 20 bp, Artificial sequence
  Synthetic Oligonucleotide
gaaatccctaccaattgttc

SEQ ID NO: 3180 - DNA, 20 bp, Artificial sequence
  Synthetic Oligonucleotide
caatcaggctttcttcaagg

SEQ ID NO: 3181 - DNA, 20 bp, Artificial sequence
  Synthetic Oligonucleotide
tgatgaagtgacagttaaat

SEQ ID NO: 3182 - DNA, 20 bp, Artificial sequence
  Synthetic Oligonucleotide
gtacaacttagagggcctgg

SEQ ID NO: 3183 - DNA, 20 bp, Artificial sequence
  Synthetic Oligonucleotide
agttctcaatactctggtat

SEQ ID NO: 3184 - DNA, 20 bp, Artificial sequence
  Synthetic Oligonucleotide
atttcacatgatgtcagtag

SEQ ID NO: 3185 - DNA, 20 bp, Artificial sequence
  Synthetic Oligonucleotide
agatagaaaagcaacaaaag

SEQ ID NO: 3186 - DNA, 20 bp, Artificial sequence
  Synthetic Oligonucleotide
caacaagtctttttaaagat

SEQ ID NO: 3187 - DNA, 20 bp, Artificial sequence
  Synthetic Oligonucleotide
aacatcagtgattctgatag

SEQ ID NO: 3188 - DNA, 20 bp, Artificial sequence
  Synthetic Oligonucleotide
ggatctagtaaagcagcatg

SEQ ID NO: 3189 - DNA, 20 bp, Artificial sequence
  Synthetic Oligonucleotide
tctctttcatatctctttta

SEQ ID NO: 3190 - DNA, 20 bp, Artificial sequence
  Synthetic Oligonucleotide
gaataggaagacagactgtg

SEQ ID NO: 3191 - DNA, 20 bp, Artificial sequence
  Synthetic Oligonucleotide
tctttataacagttctatga

SEQ ID NO: 3192 - DNA, 20 bp, Artificial sequence
  Synthetic Oligonucleotide
gacaactttttgctaataat

SEQ ID NO: 3193 - DNA, 20 bp, Artificial sequence
  Synthetic Oligonucleotide
ttcaggcctccatacccttg

SEQ ID NO: 3194 - DNA, 20 bp, Artificial sequence
  Synthetic Oligonucleotide
agagaatccatttgactttg

SEQ ID NO: 3195 - DNA, 20 bp, Artificial sequence
  Synthetic Oligonucleotide
gaatacaggaataaccactg

SEQ ID NO: 3196 - DNA, 20 bp, Artificial sequence
  Synthetic Oligonucleotide
aacagtgcacacagtgtagt

SEQ ID NO: 3197 - DNA, 20 bp, Artificial sequence
  Synthetic Oligonucleotide
ctactgtcaacacagtaatt

SEQ ID NO: 3198 - DNA, 20 bp, Artificial sequence
  Synthetic Oligonucleotide
cttctctgccccatgatgtc

SEQ ID NO: 3199 - DNA, 20 bp, Artificial sequence
  Synthetic Oligonucleotide
tttcttctgtgccaggcacg

SEQ ID NO: 3200 - DNA, 20 bp, Artificial sequence
  Synthetic Oligonucleotide
gccactattaagtggtagag

SEQ ID NO: 3201 - DNA, 20 bp, Artificial sequence
  Synthetic Oligonucleotide
ccaaggttgaccacacagga

SEQ ID NO: 3202 - DNA, 20 bp, Artificial sequence
  Synthetic Oligonucleotide
tcataagatttgacagcatg

SEQ ID NO: 3203 - DNA, 20 bp, Artificial sequence
  Synthetic Oligonucleotide
ttcagaaaccacatttctgc

SEQ ID NO: 3204 - DNA, 20 bp, Artificial sequence
  Synthetic Oligonucleotide
caatcagcaagtattttcag

SEQ ID NO: 3205 - DNA, 20 bp, Artificial sequence
  Synthetic Oligonucleotide
gtggtgcttggactgaaata

SEQ ID NO: 3206 - DNA, 20 bp, Artificial sequence
  Synthetic Oligonucleotide
ttgtactatatctaaatttc

SEQ ID NO: 3207 - DNA, 20 bp, Artificial sequence
  Synthetic Oligonucleotide
taatctgcttctcttgtggg

SEQ ID NO: 3208 - DNA, 20 bp, Artificial sequence
  Synthetic Oligonucleotide
atattaaactggcctgaaaa

SEQ ID NO: 3209 - DNA, 20 bp, Artificial sequence
  Synthetic Oligonucleotide
agcacatgtaaagctttgca

SEQ ID NO: 3210 - DNA, 20 bp, Artificial sequence
  Synthetic Oligonucleotide
ctcatgaggacttccacatt

SEQ ID NO: 3211 - DNA, 20 bp, Artificial sequence
  Synthetic Oligonucleotide
agattatttagtgcccagca

SEQ ID NO: 3212 - DNA, 20 bp, Artificial sequence
  Synthetic Oligonucleotide
cacttcaggagaatgtatat

SEQ ID NO: 3213 - DNA, 20 bp, Artificial sequence
  Synthetic Oligonucleotide
tttagcttatgatgaaattc

SEQ ID NO: 3214 - DNA, 20 bp, Artificial sequence
  Synthetic Oligonucleotide
cactattcagtaagagttcc

SEQ ID NO: 3215 - DNA, 20 bp, Artificial sequence
  Synthetic Oligonucleotide
cgctgtaatacggcatctcg

SEQ ID NO: 3216 - DNA, 20 bp, Artificial sequence
  Synthetic Oligonucleotide
atgatgtaaatttattactg

SEQ ID NO: 3217 - DNA, 20 bp, Artificial sequence
  Synthetic Oligonucleotide
gatgctgatctgattatggc

SEQ ID NO: 3218 - DNA, 20 bp, Artificial sequence
  Synthetic Oligonucleotide
ggccagtctttcacatctat

SEQ ID NO: 3219 - DNA, 20 bp, Artificial sequence
  Synthetic Oligonucleotide
ttggcacatttttacgctcc

SEQ ID NO: 3220 - DNA, 20 bp, Artificial sequence
  Synthetic Oligonucleotide
aatactgtgacatgtagttc

SEQ ID NO: 3221 - DNA, 20 bp, Artificial sequence
  Synthetic Oligonucleotide
ccaaaagaatacagcctttt

SEQ ID NO: 3222 - DNA, 20 bp, Artificial sequence
  Synthetic Oligonucleotide
gatattggaatggtgagcct

SEQ ID NO: 3223 - DNA, 20 bp, Artificial sequence
  Synthetic Oligonucleotide
tagtaaaccaaatgaataaa

SEQ ID NO: 3224 - DNA, 20 bp, Artificial sequence
  Synthetic Oligonucleotide
cctttaagcttaacagtctt

SEQ ID NO: 3225 - DNA, 20 bp, Artificial sequence
  Synthetic Oligonucleotide
ttactggtaagtatttttac

SEQ ID NO: 3226 - DNA, 20 bp, Artificial sequence
  Synthetic Oligonucleotide
ggtaagctatgtaaacaatt

SEQ ID NO: 3227 - DNA, 20 bp, Artificial sequence
  Synthetic Oligonucleotide
aactattcataatcttctca

SEQ ID NO: 3228 - DNA, 20 bp, Artificial sequence
  Synthetic Oligonucleotide
ttggctgtgcaaaagaagga

SEQ ID NO: 3229 - DNA, 20 bp, Artificial sequence
  Synthetic Oligonucleotide
ctgctacatgataaggaagc

SEQ ID NO: 3230 - DNA, 20 bp, Artificial sequence
  Synthetic Oligonucleotide
cacaccctttatgtactgaa

SEQ ID NO: 3231 - DNA, 20 bp, Artificial sequence
  Synthetic Oligonucleotide
tcttagtggccaaagcaact

SEQ ID NO: 3232 - DNA, 20 bp, Artificial sequence
  Synthetic Oligonucleotide
tcacaagctctgtgtcctca

SEQ ID NO: 3233 - DNA, 20 bp, Artificial sequence
  Synthetic Oligonucleotide
tcataaccccacacctttac

SEQ ID NO: 3234 - DNA, 20 bp, Artificial sequence
  Synthetic Oligonucleotide
ttttttttgatgtggagaaa

SEQ ID NO: 3235 - DNA, 20 bp, Artificial sequence
  Synthetic Oligonucleotide
gactcatgtaagaagacaag

SEQ ID NO: 3236 - DNA, 20 bp, Artificial sequence
  Synthetic Oligonucleotide
tttaattttaactatgaaga

SEQ ID NO: 3237 - DNA, 20 bp, Artificial sequence
  Synthetic Oligonucleotide
taacagtttgaccaactcta

SEQ ID NO: 3238 - DNA, 20 bp, Artificial sequence
  Synthetic Oligonucleotide
aattcaaacaaaatgttagt

SEQ ID NO: 3239 - DNA, 20 bp, Artificial sequence
  Synthetic Oligonucleotide
ttactcaatagtcaccttct

SEQ ID NO: 3240 - DNA, 20 bp, Artificial sequence
  Synthetic Oligonucleotide
ttccaatacttaaaacaagt

SEQ ID NO: 3241 - DNA, 20 bp, Artificial sequence
  Synthetic Oligonucleotide
aagatagaattcatagtaat

SEQ ID NO: 3242 - DNA, 20 bp, Artificial sequence
  Synthetic Oligonucleotide
ccatggacctccaacccaat

SEQ ID NO: 3243 - DNA, 20 bp, Artificial sequence
  Synthetic Oligonucleotide
cactacaagtcaaaaatgtg

SEQ ID NO: 3244 - DNA, 20 bp, Artificial sequence
  Synthetic Oligonucleotide
atttttaagggagatctctc

SEQ ID NO: 3245 - DNA, 20 bp, Artificial sequence
  Synthetic Oligonucleotide
ttcatgtctaataatcttta

SEQ ID NO: 3246 - DNA, 20 bp, Artificial sequence
  Synthetic Oligonucleotide
tctaaagaaattcagacaac

SEQ ID NO: 3247 - DNA, 20 bp, Artificial sequence
  Synthetic Oligonucleotide
caaagaaaaaagtccaataa

SEQ ID NO: 3248 - DNA, 20 bp, Artificial sequence
  Synthetic Oligonucleotide
gcaacctgcaataaaaccca

SEQ ID NO: 3249 - DNA, 20 bp, Artificial sequence
  Synthetic Oligonucleotide
agactaagttgtagagatgc

SEQ ID NO: 3250 - DNA, 20 bp, Artificial sequence
  Synthetic Oligonucleotide
taaaataaataaatgccagc

SEQ ID NO: 3251 - DNA, 20 bp, Artificial sequence
  Synthetic Oligonucleotide
actaaaagactagtgactta

SEQ ID NO: 3252 - DNA, 20 bp, Artificial sequence
  Synthetic Oligonucleotide
gaacccatttctggagggtt

SEQ ID NO: 3253 - DNA, 20 bp, Artificial sequence
  Synthetic Oligonucleotide
cactagaacagctaaaagta

SEQ ID NO: 3254 - DNA, 20 bp, Artificial sequence
  Synthetic Oligonucleotide
tcactaacaggataattaaa

SEQ ID NO: 3255 - DNA, 20 bp, Artificial sequence
  Synthetic Oligonucleotide
tgaagtgtactgtaagtata

SEQ ID NO: 3256 - DNA, 20 bp, Artificial sequence
  Synthetic Oligonucleotide
cttgaaagttacaaggataa

SEQ ID NO: 3257 - DNA, 20 bp, Artificial sequence
  Synthetic Oligonucleotide
ggtgggtaggttggctggag

SEQ ID NO: 3258 - DNA, 20 bp, Artificial sequence
  Synthetic Oligonucleotide
actgaaatgccacttttaaa

SEQ ID NO: 3259 - DNA, 20 bp, Artificial sequence
  Synthetic Oligonucleotide
atgggtgttatttaataaaa

SEQ ID NO: 3260 - DNA, 20 bp, Artificial sequence
  Synthetic Oligonucleotide
aagtgtaaagaccagaaaca

SEQ ID NO: 3261 - DNA, 20 bp, Artificial sequence
  Synthetic Oligonucleotide
tagtctccattctaaaaagc

SEQ ID NO: 3262 - DNA, 20 bp, Artificial sequence
  Synthetic Oligonucleotide
gacttattggtaatgatatc

SEQ ID NO: 3263 - DNA, 20 bp, Artificial sequence
  Synthetic Oligonucleotide
gcagagacataaaatcccac

SEQ ID NO: 3264 - DNA, 20 bp, Artificial sequence
  Synthetic Oligonucleotide
ttccatgtgaaatataagaa

SEQ ID NO: 3265 - DNA, 20 bp, Artificial sequence
  Synthetic Oligonucleotide
aaggttaaattgccatgtaa

SEQ ID NO: 3266 - DNA, 20 bp, Artificial sequence
  Synthetic Oligonucleotide
ctaggagaggacttccatga

SEQ ID NO: 3267 - DNA, 20 bp, Artificial sequence
  Synthetic Oligonucleotide
attatatggcagacatgttg

SEQ ID NO: 3268 - DNA, 20 bp, Artificial sequence
  Synthetic Oligonucleotide
ttggacaactttttgctaat

SEQ ID NO: 3269 - DNA, 20 bp, Artificial sequence
  Synthetic Oligonucleotide
accttcaggcctccataccc

SEQ ID NO: 3270 - DNA, 20 bp, Artificial sequence
  Synthetic Oligonucleotide
cctttatttttataaattga

SEQ ID NO: 3271 - DNA, 20 bp, Artificial sequence
  Synthetic Oligonucleotide
tacagttgagttctggtata

SEQ ID NO: 3272 - DNA, 20 bp, Artificial sequence
  Synthetic Oligonucleotide
gaaacagtgcacacagtgta

SEQ ID NO: 3273 - DNA, 20 bp, Artificial sequence
  Synthetic Oligonucleotide
aaaaactagaacctagagtt

SEQ ID NO: 3274 - DNA, 20 bp, Artificial sequence
  Synthetic Oligonucleotide
agatgtctataaaattctga

SEQ ID NO: 3275 - DNA, 20 bp, Artificial sequence
  Synthetic Oligonucleotide
aaccaggcattggaatctgg

SEQ ID NO: 3276 - DNA, 20 bp, Artificial sequence
  Synthetic Oligonucleotide
aatttcttgatgaacatcat

SEQ ID NO: 3277 - DNA, 20 bp, Artificial sequence
  Synthetic Oligonucleotide
ctaaaccaggctgtgttatt

SEQ ID NO: 3278 - DNA, 20 bp, Artificial sequence
  Synthetic Oligonucleotide
ttttcataagatttgacagc

SEQ ID NO: 3279 - DNA, 20 bp, Artificial sequence
  Synthetic Oligonucleotide
tttaacctcagaactaatgt

SEQ ID NO: 3280 - DNA, 20 bp, Artificial sequence
  Synthetic Oligonucleotide
atcagatgtcatttatcatt

SEQ ID NO: 3281 - DNA, 20 bp, Artificial sequence
  Synthetic Oligonucleotide
agcacaaagtcacctaacct

SEQ ID NO: 3282 - DNA, 20 bp, Artificial sequence
  Synthetic Oligonucleotide
tctatgtggctctttgtaga

SEQ ID NO: 3283 - DNA, 20 bp, Artificial sequence
  Synthetic Oligonucleotide
agctgcagtaatctgcttct

SEQ ID NO: 3284 - DNA, 20 bp, Artificial sequence
  Synthetic Oligonucleotide
atatattaaactggcctgaa

SEQ ID NO: 3285 - DNA, 20 bp, Artificial sequence
  Synthetic Oligonucleotide
caaacagcacatgtaaagct

SEQ ID NO: 3286 - DNA, 20 bp, Artificial sequence
  Synthetic Oligonucleotide
actcatgaggacttccacat

SEQ ID NO: 3287 - DNA, 20 bp, Artificial sequence
  Synthetic Oligonucleotide
gagattatttagtgcccagc

SEQ ID NO: 3288 - DNA, 20 bp, Artificial sequence
  Synthetic Oligonucleotide
ccacttcaggagaatgtata

SEQ ID NO: 3289 - DNA, 20 bp, Artificial sequence
  Synthetic Oligonucleotide
tatttagcttatgatgaaat

SEQ ID NO: 3290 - DNA, 20 bp, Artificial sequence
  Synthetic Oligonucleotide
agatccactattcagtaaga

SEQ ID NO: 3291 - DNA, 20 bp, Artificial sequence
  Synthetic Oligonucleotide
acgctgtaatacggcatctc

SEQ ID NO: 3292 - DNA, 20 bp, Artificial sequence
  Synthetic Oligonucleotide
gattagcaatacaactcatt

SEQ ID NO: 3293 - DNA, 20 bp, Artificial sequence
  Synthetic Oligonucleotide
agatgctgatctgattatgg

SEQ ID NO: 3294 - DNA, 20 bp, Artificial sequence
  Synthetic Oligonucleotide
ggataggccagtctttcaca

SEQ ID NO: 3295 - DNA, 20 bp, Artificial sequence
  Synthetic Oligonucleotide
aattggcacatttttacgct

SEQ ID NO: 3296 - DNA, 20 bp, Artificial sequence
  Synthetic Oligonucleotide
aaaatactgtgacatgtagt

SEQ ID NO: 3297 - DNA, 20 bp, Artificial sequence
  Synthetic Oligonucleotide
acaacttggcccaaaagaat

SEQ ID NO: 3298 - DNA, 20 bp, Artificial sequence
  Synthetic Oligonucleotide
tcagccaaaatcaagtcagg

SEQ ID NO: 3299 - DNA, 20 bp, Artificial sequence
  Synthetic Oligonucleotide
tagagtagtaaaccaaatga

SEQ ID NO: 3300 - DNA, 20 bp, Artificial sequence
  Synthetic Oligonucleotide
cagctcctttaagcttaaca

SEQ ID NO: 3301 - DNA, 20 bp, Artificial sequence
  Synthetic Oligonucleotide
cacatttactggtaagtatt

SEQ ID NO: 3302 - DNA, 20 bp, Artificial sequence
  Synthetic Oligonucleotide
aattattacataggtatttg

SEQ ID NO: 3303 - DNA, 20 bp, Artificial sequence
  Synthetic Oligonucleotide
ggtatactacaactaaaggc

SEQ ID NO: 3304 - DNA, 20 bp, Artificial sequence
  Synthetic Oligonucleotide
caaatattggctgtgcaaaa

SEQ ID NO: 3305 - DNA, 20 bp, Artificial sequence
  Synthetic Oligonucleotide
taagccagattgtataagaa

SEQ ID NO: 3306 - DNA, 20 bp, Artificial sequence
  Synthetic Oligonucleotide
acacaccctttatgtactga

SEQ ID NO: 3307 - DNA, 20 bp, Artificial sequence
  Synthetic Oligonucleotide
ctacctcttagtggccaaag

SEQ ID NO: 3308 - DNA, 20 bp, Artificial sequence
  Synthetic Oligonucleotide
taattgaactgtactgtcac

SEQ ID NO: 3309 - DNA, 20 bp, Artificial sequence
  Synthetic Oligonucleotide
cactcataaccccacacctt

SEQ ID NO: 3310 - DNA, 20 bp, Artificial sequence
  Synthetic Oligonucleotide
tgttatattgcttacctttt

SEQ ID NO: 3311 - DNA, 20 bp, Artificial sequence
  Synthetic Oligonucleotide
tcaatggctctatttaacac

SEQ ID NO: 3312 - DNA, 20 bp, Artificial sequence
  Synthetic Oligonucleotide
gttttaattttaactatgaa

SEQ ID NO: 3313 - DNA, 20 bp, Artificial sequence
  Synthetic Oligonucleotide
cattatatatattatctact

SEQ ID NO: 3314 - DNA, 20 bp, Artificial sequence
  Synthetic Oligonucleotide
aaattcaaacaaaatgttag

SEQ ID NO: 3315 - DNA, 20 bp, Artificial sequence
  Synthetic Oligonucleotide
cttactcaatagtcaccttc

SEQ ID NO: 3316 - DNA, 20 bp, Artificial sequence
  Synthetic Oligonucleotide
acacatgtcatttccaattt

SEQ ID NO: 3317 - DNA, 20 bp, Artificial sequence
  Synthetic Oligonucleotide
taattgtctaaactttgaac

SEQ ID NO: 3318 - DNA, 20 bp, Artificial sequence
  Synthetic Oligonucleotide
tcacatcaaacagatctccc

SEQ ID NO: 3319 - DNA, 20 bp, Artificial sequence
  Synthetic Oligonucleotide
tgtagctgaactatgctaaa

SEQ ID NO: 3320 - DNA, 20 bp, Artificial sequence
  Synthetic Oligonucleotide
tgtattaaagtttgagtata

SEQ ID NO: 3321 - DNA, 20 bp, Artificial sequence
  Synthetic Oligonucleotide
ccacagtgaacattcatgtc

SEQ ID NO: 3322 - DNA, 20 bp, Artificial sequence
  Synthetic Oligonucleotide
gtccaaatataaaggcaaaa

SEQ ID NO: 3323 - DNA, 20 bp, Artificial sequence
  Synthetic Oligonucleotide
agaagtggtaagttaaaaag

SEQ ID NO: 3324 - DNA, 20 bp, Artificial sequence
  Synthetic Oligonucleotide
ccagtatcttgaattcctta

SEQ ID NO: 3325 - DNA, 20 bp, Artificial sequence
  Synthetic Oligonucleotide
tatcaaaacattagaactat

SEQ ID NO: 3326 - DNA, 20 bp, Artificial sequence
  Synthetic Oligonucleotide
gagaaagtgaatctgataaa

SEQ ID NO: 3327 - DNA, 20 bp, Artificial sequence
  Synthetic Oligonucleotide
atctttggcttaaggtccct

SEQ ID NO: 3328 - DNA, 20 bp, Artificial sequence
  Synthetic Oligonucleotide
tgaagattaaagtaagcagg

SEQ ID NO: 3329 - DNA, 20 bp, Artificial sequence
  Synthetic Oligonucleotide
aataagaatggccaataaga

SEQ ID NO: 3330 - DNA, 20 bp, Artificial sequence
  Synthetic Oligonucleotide
caggataattaaatcactaa

SEQ ID NO: 3331 - DNA, 20 bp, Artificial sequence
  Synthetic Oligonucleotide
tcttgaagtgtactgtaagt

SEQ ID NO: 3332 - DNA, 20 bp, Artificial sequence
  Synthetic Oligonucleotide
aaatgtcttgaaagttacaa

SEQ ID NO: 3333 - DNA, 20 bp, Artificial sequence
  Synthetic Oligonucleotide
accgaatgagaattaggtgg

SEQ ID NO: 3334 - DNA, 20 bp, Artificial sequence
  Synthetic Oligonucleotide
ataattttgtctcttccaga

SEQ ID NO: 3335 - DNA, 20 bp, Artificial sequence
  Synthetic Oligonucleotide
tatggtactagctcataaag

SEQ ID NO: 3336 - DNA, 20 bp, Artificial sequence
  Synthetic Oligonucleotide
tatgagaaagtaataagacc

SEQ ID NO: 3337 - DNA, 20 bp, Artificial sequence
  Synthetic Oligonucleotide
gtttagtctccattctaaaa

SEQ ID NO: 3338 - DNA, 20 bp, Artificial sequence
  Synthetic Oligonucleotide
aggtgatttataagtgccaa

SEQ ID NO: 3339 - DNA, 20 bp, Artificial sequence
  Synthetic Oligonucleotide
ggttatttgtaaaatgttat

SEQ ID NO: 3340 - DNA, 20 bp, Artificial sequence
  Synthetic Oligonucleotide
cattttccatgtgaaatata

SEQ ID NO: 3341 - DNA, 20 bp, Artificial sequence
  Synthetic Oligonucleotide
aaattcctttgtatttctcc

SEQ ID NO: 3342 - DNA, 20 bp, Artificial sequence
  Synthetic Oligonucleotide
gtctcatcaataatatattc

SEQ ID NO: 3343 - DNA, 20 bp, Artificial sequence
  Synthetic Oligonucleotide
tgttattatatggcagacat

SEQ ID NO: 3344 - DNA, 20 bp, Artificial sequence
  Synthetic Oligonucleotide
ctcaaattttggacaacttt

SEQ ID NO: 3345 - DNA, 20 bp, Artificial sequence
  Synthetic Oligonucleotide
atgctttgtaccttcaggcc

SEQ ID NO: 3346 - DNA, 20 bp, Artificial sequence
  Synthetic Oligonucleotide
ttagaaacacttgaagtcat

SEQ ID NO: 3347 - DNA, 20 bp, Artificial sequence
  Synthetic Oligonucleotide
aattaaaatgcccccaggat

SEQ ID NO: 3348 - DNA, 20 bp, Artificial sequence
  Synthetic Oligonucleotide
ctctgtttttatcagacatt

SEQ ID NO: 3349 - DNA, 20 bp, Artificial sequence
  Synthetic Oligonucleotide
gttatttaaagtaaggtttc

SEQ ID NO: 3350 - DNA, 20 bp, Artificial sequence
  Synthetic Oligonucleotide
ttcatctcaaccaggtctta

SEQ ID NO: 3351 - DNA, 20 bp, Artificial sequence
  Synthetic Oligonucleotide
agttgcatatggtttaggag

SEQ ID NO: 3352 - DNA, 20 bp, Artificial sequence
  Synthetic Oligonucleotide
aatatttacttcaatatgga

SEQ ID NO: 3353 - DNA, 20 bp, Artificial sequence
  Synthetic Oligonucleotide
catccaaggaggcatacact

SEQ ID NO: 3354 - DNA, 20 bp, Artificial sequence
  Synthetic Oligonucleotide
ttaaaggaaaagttaaccag

SEQ ID NO: 3355 - DNA, 20 bp, Artificial sequence
  Synthetic Oligonucleotide
gattgttcctctccctctcc

SEQ ID NO: 3356 - DNA, 20 bp, Artificial sequence
  Synthetic Oligonucleotide
taatgactaaataggaatct

SEQ ID NO: 3357 - DNA, 20 bp, Artificial sequence
  Synthetic Oligonucleotide
gtagatttagtggtattgag

SEQ ID NO: 3358 - DNA, 20 bp, Artificial sequence
  Synthetic Oligonucleotide
actttatattaatttcttgt

SEQ ID NO: 3359 - DNA, 20 bp, Artificial sequence
  Synthetic Oligonucleotide
taccatgtatttcccatttt

SEQ ID NO: 3360 - DNA, 20 bp, Artificial sequence
  Synthetic Oligonucleotide
ttctgttaaaactatatatt

SEQ ID NO: 3361 - DNA, 20 bp, Artificial sequence
  Synthetic Oligonucleotide
acttaacaatatcatataat

SEQ ID NO: 3362 - DNA, 20 bp, Artificial sequence
  Synthetic Oligonucleotide
attgccactcatgaggactt

SEQ ID NO: 3363 - DNA, 20 bp, Artificial sequence
  Synthetic Oligonucleotide
cataaggagattatttagtg

SEQ ID NO: 3364 - DNA, 20 bp, Artificial sequence
  Synthetic Oligonucleotide
ttcagccacttcaggagaat

SEQ ID NO: 3365 - DNA, 20 bp, Artificial sequence
  Synthetic Oligonucleotide
aaccatatttagcttatgat

SEQ ID NO: 3366 - DNA, 20 bp, Artificial sequence
  Synthetic Oligonucleotide
tgtcacctttcccaatgctt

SEQ ID NO: 3367 - DNA, 20 bp, Artificial sequence
  Synthetic Oligonucleotide
gtgaatcatctgaagataat

SEQ ID NO: 3368 - DNA, 20 bp, Artificial sequence
  Synthetic Oligonucleotide
tctaccacatcagtgaggtt

SEQ ID NO: 3369 - DNA, 20 bp, Artificial sequence
  Synthetic Oligonucleotide
gtttctctactctagaccat

SEQ ID NO: 3370 - DNA, 20 bp, Artificial sequence
  Synthetic Oligonucleotide
gtactatagaattcctcacg

SEQ ID NO: 3371 - DNA, 20 bp, Artificial sequence
  Synthetic Oligonucleotide
aattcaattggcacattttt

SEQ ID NO: 3372 - DNA, 20 bp, Artificial sequence
  Synthetic Oligonucleotide
gaatttttctaggagcttaa

SEQ ID NO: 3373 - DNA, 20 bp, Artificial sequence
  Synthetic Oligonucleotide
tggtccacaacttggcccaa

SEQ ID NO: 3374 - DNA, 20 bp, Artificial sequence
  Synthetic Oligonucleotide
tatttctaggcaggtcagcc

SEQ ID NO: 3375 - DNA, 20 bp, Artificial sequence
  Synthetic Oligonucleotide
aggcctttcttgaggatttt

SEQ ID NO: 3376 - DNA, 20 bp, Artificial sequence
  Synthetic Oligonucleotide
gagaaaatctttgtgccaca

SEQ ID NO: 3377 - DNA, 20 bp, Artificial sequence
  Synthetic Oligonucleotide
acagaatttaaaataaagtt

SEQ ID NO: 3378 - DNA, 20 bp, Artificial sequence
  Synthetic Oligonucleotide
tatcacagggaattatctga

SEQ ID NO: 3379 - DNA, 20 bp, Artificial sequence
  Synthetic Oligonucleotide
atcaccttggcctataattt

SEQ ID NO: 3380 - DNA, 20 bp, Artificial sequence
  Synthetic Oligonucleotide
ttgctttttactagcttgca

SEQ ID NO: 3381 - DNA, 20 bp, Artificial sequence
  Synthetic Oligonucleotide
ggctctttcacatttcgaaa

SEQ ID NO: 3382 - DNA, 20 bp, Artificial sequence
  Synthetic Oligonucleotide
tttcctacataaacttttat

SEQ ID NO: 3383 - DNA, 20 bp, Artificial sequence
  Synthetic Oligonucleotide
gttgagtaccttcttgtttt

SEQ ID NO: 3384 - DNA, 20 bp, Artificial sequence
  Synthetic Oligonucleotide
tcttgtgtattataattatc

SEQ ID NO: 3385 - DNA, 20 bp, Artificial sequence
  Synthetic Oligonucleotide
agcaatcattggtagcatac

SEQ ID NO: 3386 - DNA, 20 bp, Artificial sequence
  Synthetic Oligonucleotide
gtactgaaaatgaaagtctg

SEQ ID NO: 3387 - DNA, 20 bp, Artificial sequence
  Synthetic Oligonucleotide
aaggtaaggtctcaaccaga

SEQ ID NO: 3388 - DNA, 20 bp, Artificial sequence
  Synthetic Oligonucleotide
tcattggcatgtttaccatt

SEQ ID NO: 3389 - DNA, 20 bp, Artificial sequence
  Synthetic Oligonucleotide
ctaacaataaaagttacggt

SEQ ID NO: 3390 - DNA, 20 bp, Artificial sequence
  Synthetic Oligonucleotide
aatttggttataaaagagta

SEQ ID NO: 3391 - DNA, 20 bp, Artificial sequence
  Synthetic Oligonucleotide
caggtcttactcaatagtca

SEQ ID NO: 3392 - DNA, 20 bp, Artificial sequence
  Synthetic Oligonucleotide
agcatcaggttcaaaagcaa

SEQ ID NO: 3393 - DNA, 20 bp, Artificial sequence
  Synthetic Oligonucleotide
cattgtagttactttgtata

SEQ ID NO: 3394 - DNA, 20 bp, Artificial sequence
  Synthetic Oligonucleotide
aaactatgaataggacacca

SEQ ID NO: 3395 - DNA, 20 bp, Artificial sequence
  Synthetic Oligonucleotide
ctggaagatttttatgcaac

SEQ ID NO: 3396 - DNA, 20 bp, Artificial sequence
  Synthetic Oligonucleotide
ctctcacaatgagacaggat

SEQ ID NO: 3397 - DNA, 20 bp, Artificial sequence
  Synthetic Oligonucleotide
ggtggagaaataaaaatatc

SEQ ID NO: 3398 - DNA, 20 bp, Artificial sequence
  Synthetic Oligonucleotide
gatgtcccttgtctatgagt

SEQ ID NO: 3399 - DNA, 20 bp, Artificial sequence
  Synthetic Oligonucleotide
gtctttgaccaaaatcttct

SEQ ID NO: 3400 - DNA, 20 bp, Artificial sequence
  Synthetic Oligonucleotide
ctatcttggtttaatcagcc

SEQ ID NO: 3401 - DNA, 20 bp, Artificial sequence
  Synthetic Oligonucleotide
atatattttcatagactgac

SEQ ID NO: 3402 - DNA, 20 bp, Artificial sequence
  Synthetic Oligonucleotide
catcttgaaacaggaaaccc

SEQ ID NO: 3403 - DNA, 20 bp, Artificial sequence
  Synthetic Oligonucleotide
gcttgaaagtataaagaaaa

SEQ ID NO: 3404 - DNA, 20 bp, Artificial sequence
  Synthetic Oligonucleotide
gctaaataaaggatcttgtt

SEQ ID NO: 3405 - DNA, 20 bp, Artificial sequence
  Synthetic Oligonucleotide
tcttaagtgggatacaaaaa

SEQ ID NO: 3406 - DNA, 20 bp, Artificial sequence
  Synthetic Oligonucleotide
aattacaacttcaatatttc

SEQ ID NO: 3407 - DNA, 20 bp, Artificial sequence
  Synthetic Oligonucleotide
caaagtgaacctgagaataa

SEQ ID NO: 3408 - DNA, 20 bp, Artificial sequence
  Synthetic Oligonucleotide
tctgtttccattgcctgccc

SEQ ID NO: 3409 - DNA, 20 bp, Artificial sequence
  Synthetic Oligonucleotide
attattttgcttgctcattt

SEQ ID NO: 3410 - DNA, 20 bp, Artificial sequence
  Synthetic Oligonucleotide
tatctcagtatcaggatgcc

SEQ ID NO: 3411 - DNA, 20 bp, Artificial sequence
  Synthetic Oligonucleotide
tacataaacttgcctaatct

SEQ ID NO: 3412 - DNA, 20 bp, Artificial sequence
  Synthetic Oligonucleotide
atggaaatctggatttatag

SEQ ID NO: 3413 - DNA, 20 bp, Artificial sequence
  Synthetic Oligonucleotide
tcagaaaacaaaatccttcc

SEQ ID NO: 3414 - DNA, 20 bp, Artificial sequence
  Synthetic Oligonucleotide
cattaaaaaatacccaaatt

SEQ ID NO: 3415 - DNA, 20 bp, Artificial sequence
  Synthetic Oligonucleotide
tcaaaccattatgccagaat

SEQ ID NO: 3416 - DNA, 20 bp, Artificial sequence
  Synthetic Oligonucleotide
aatgtgaaacagacacgcta

SEQ ID NO: 3417 - DNA, 20 bp, Artificial sequence
  Synthetic Oligonucleotide
aatgtttcaatatgctcttg

SEQ ID NO: 3418 - DNA, 20 bp, Artificial sequence
  Synthetic Oligonucleotide
attttaagcctccaagtttc

SEQ ID NO: 3419 - DNA, 20 bp, Artificial sequence
  Synthetic Oligonucleotide
caaaataaatgatacatgtc

SEQ ID NO: 3420 - DNA, 20 bp, Artificial sequence
  Synthetic Oligonucleotide
catcctaatttttattctca

SEQ ID NO: 3421 - DNA, 20 bp, Artificial sequence
  Synthetic Oligonucleotide
agccaaaatggcaacagctc

SEQ ID NO: 3422 - DNA, 20 bp, Artificial sequence
  Synthetic Oligonucleotide
tcattccactttgattgtgt

SEQ ID NO: 3423 - DNA, 20 bp, Artificial sequence
  Synthetic Oligonucleotide
ggaattttcttcaaattttg

SEQ ID NO: 3424 - DNA, 20 bp, Artificial sequence
  Synthetic Oligonucleotide
tcataggcacagacagaggt

SEQ ID NO: 3425 - DNA, 20 bp, Artificial sequence
  Synthetic Oligonucleotide
actacagttgacctatggac

SEQ ID NO: 3426 - DNA, 20 bp, Artificial sequence
  Synthetic Oligonucleotide
attgcaagcataaacagatt

SEQ ID NO: 3427 - DNA, 20 bp, Artificial sequence
  Synthetic Oligonucleotide
atgaatattttaactatttc

SEQ ID NO: 3428 - DNA, 20 bp, Artificial sequence
  Synthetic Oligonucleotide
gctattcatggctctgttgt

SEQ ID NO: 3429 - DNA, 20 bp, Artificial sequence
  Synthetic Oligonucleotide
gttagaatttggaatcacag

SEQ ID NO: 3430 - DNA, 20 bp, Artificial sequence
  Synthetic Oligonucleotide
caaatgtggagttctaacag

SEQ ID NO: 3431 - DNA, 20 bp, Artificial sequence
  Synthetic Oligonucleotide
tggacaaggttacttgggca

SEQ ID NO: 3432 - DNA, 20 bp, Artificial sequence
  Synthetic Oligonucleotide
tttataaatgtctcagctag

SEQ ID NO: 3433 - DNA, 20 bp, Artificial sequence
  Synthetic Oligonucleotide
attgctatagccactacgga

SEQ ID NO: 3434 - DNA, 20 bp, Artificial sequence
  Synthetic Oligonucleotide
ctagaactccaaaagtccta

SEQ ID NO: 3435 - DNA, 20 bp, Artificial sequence
  Synthetic Oligonucleotide
acaagctagactattgcaat

SEQ ID NO: 3436 - DNA, 20 bp, Artificial sequence
  Synthetic Oligonucleotide
gaatatattttcttcaccat

SEQ ID NO: 3437 - DNA, 20 bp, Artificial sequence
  Synthetic Oligonucleotide
aaactaccaattaaaattcc

SEQ ID NO: 3438 - DNA, 20 bp, Artificial sequence
  Synthetic Oligonucleotide
cacttaacaatatcatataa

SEQ ID NO: 3439 - DNA, 20 bp, Artificial sequence
  Synthetic Oligonucleotide
cattgccactcatgaggact

SEQ ID NO: 3440 - DNA, 20 bp, Artificial sequence
  Synthetic Oligonucleotide
tgttttggtacataaggaga

SEQ ID NO: 3441 - DNA, 20 bp, Artificial sequence
  Synthetic Oligonucleotide
tttcagccacttcaggagaa

SEQ ID NO: 3442 - DNA, 20 bp, Artificial sequence
  Synthetic Oligonucleotide
taaccatatttagcttatga

SEQ ID NO: 3443 - DNA, 20 bp, Artificial sequence
  Synthetic Oligonucleotide
ctgtcacctttcccaatgct

SEQ ID NO: 3444 - DNA, 20 bp, Artificial sequence
  Synthetic Oligonucleotide
ctagtgatgtaatatattct

SEQ ID NO: 3445 - DNA, 20 bp, Artificial sequence
  Synthetic Oligonucleotide
gtttctctaccacatcagtg

SEQ ID NO: 3446 - DNA, 20 bp, Artificial sequence
  Synthetic Oligonucleotide
cagtttctctactctagacc

SEQ ID NO: 3447 - DNA, 20 bp, Artificial sequence
  Synthetic Oligonucleotide
gagtactatagaattcctca

SEQ ID NO: 3448 - DNA, 20 bp, Artificial sequence
  Synthetic Oligonucleotide
cgggaaattcaattggcaca

SEQ ID NO: 3449 - DNA, 20 bp, Artificial sequence
  Synthetic Oligonucleotide
ggaatttttctaggagctta

SEQ ID NO: 3450 - DNA, 20 bp, Artificial sequence
  Synthetic Oligonucleotide
ttcagctgaattcaaaatgt

SEQ ID NO: 3451 - DNA, 20 bp, Artificial sequence
  Synthetic Oligonucleotide
ccactgttatgatgttggaa

SEQ ID NO: 3452 - DNA, 20 bp, Artificial sequence
  Synthetic Oligonucleotide
atttctagaaaaatcgacaa

SEQ ID NO: 3453 - DNA, 20 bp, Artificial sequence
  Synthetic Oligonucleotide
tgtcctatcacagggaatta

SEQ ID NO: 3454 - DNA, 20 bp, Artificial sequence
  Synthetic Oligonucleotide
gtctgtcaagcctctcaacc

SEQ ID NO: 3455 - DNA, 20 bp, Artificial sequence
  Synthetic Oligonucleotide
tatcaaaccattttgctttt

SEQ ID NO: 3456 - DNA, 20 bp, Artificial sequence
  Synthetic Oligonucleotide
cagatttctctagaatgaat

SEQ ID NO: 3457 - DNA, 20 bp, Artificial sequence
  Synthetic Oligonucleotide
tgtgtctatcttcttcacaa

SEQ ID NO: 3458 - DNA, 20 bp, Artificial sequence
  Synthetic Oligonucleotide
agactcttagtgcatgccat

SEQ ID NO: 3459 - DNA, 20 bp, Artificial sequence
  Synthetic Oligonucleotide
ccttagaaacacagtaaact

SEQ ID NO: 3460 - DNA, 20 bp, Artificial sequence
  Synthetic Oligonucleotide
aaaacagaatatgaaccatt

SEQ ID NO: 3461 - DNA, 20 bp, Artificial sequence
  Synthetic Oligonucleotide
ggaaaagtactgaaaatgaa

SEQ ID NO: 3462 - DNA, 20 bp, Artificial sequence
  Synthetic Oligonucleotide
cagactctctgcaaggtaag

SEQ ID NO: 3463 - DNA, 20 bp, Artificial sequence
  Synthetic Oligonucleotide
cttaaaggaatagtgcttag

SEQ ID NO: 3464 - DNA, 20 bp, Artificial sequence
  Synthetic Oligonucleotide
aattaccaaatgacccttga

SEQ ID NO: 3465 - DNA, 20 bp, Artificial sequence
  Synthetic Oligonucleotide
tggtgtttactatgggttcc

SEQ ID NO: 3466 - DNA, 20 bp, Artificial sequence
  Synthetic Oligonucleotide
tgcaggtcttactcaatagt

SEQ ID NO: 3467 - DNA, 20 bp, Artificial sequence
  Synthetic Oligonucleotide
cacacaataattagaaaaac

SEQ ID NO: 3468 - DNA, 20 bp, Artificial sequence
  Synthetic Oligonucleotide
tcatggcaacaaaaatagaa

SEQ ID NO: 3469 - DNA, 20 bp, Artificial sequence
  Synthetic Oligonucleotide
tgtcaactttaaggataatc

SEQ ID NO: 3470 - DNA, 20 bp, Artificial sequence
  Synthetic Oligonucleotide
taaatataatgtgtaagaat

SEQ ID NO: 3471 - DNA, 20 bp, Artificial sequence
  Synthetic Oligonucleotide
caccaacactcaccatgaat

SEQ ID NO: 3472 - DNA, 20 bp, Artificial sequence
  Synthetic Oligonucleotide
ccctcagggacctctactga

SEQ ID NO: 3473 - DNA, 20 bp, Artificial sequence
  Synthetic Oligonucleotide
atttatcagtgtctacttag

SEQ ID NO: 3474 - DNA, 20 bp, Artificial sequence
  Synthetic Oligonucleotide
ttcatttagatgatgttttg

SEQ ID NO: 3475 - DNA, 20 bp, Artificial sequence
  Synthetic Oligonucleotide
actctactatagagattcta

SEQ ID NO: 3476 - DNA, 20 bp, Artificial sequence
  Synthetic Oligonucleotide
atttaataatgtgtattaaa

SEQ ID NO: 3477 - DNA, 20 bp, Artificial sequence
  Synthetic Oligonucleotide
tacaaaccatcttgaaacag

SEQ ID NO: 3478 - DNA, 20 bp, Artificial sequence
  Synthetic Oligonucleotide
atgagcttgaaagtataaag

SEQ ID NO: 3479 - DNA, 20 bp, Artificial sequence
  Synthetic Oligonucleotide
gtatcagtgtcctcacctgg

SEQ ID NO: 3480 - DNA, 20 bp, Artificial sequence
  Synthetic Oligonucleotide
ttcttaagtgggatacaaaa

SEQ ID NO: 3481 - DNA, 20 bp, Artificial sequence
  Synthetic Oligonucleotide
atagtccttaatgtttgcac

SEQ ID NO: 3482 - DNA, 20 bp, Artificial sequence
  Synthetic Oligonucleotide
tttcaaagtgaacctgagaa

SEQ ID NO: 3483 - DNA, 20 bp, Artificial sequence
  Synthetic Oligonucleotide
atctgtttccattgcctgcc

SEQ ID NO: 3484 - DNA, 20 bp, Artificial sequence
  Synthetic Oligonucleotide
ccttgtcacagtctcttcca

SEQ ID NO: 3485 - DNA, 20 bp, Artificial sequence
  Synthetic Oligonucleotide
aaaaccattaaatgattaat

SEQ ID NO: 3486 - DNA, 20 bp, Artificial sequence
  Synthetic Oligonucleotide
aacacactcaagatccaatt

SEQ ID NO: 3487 - DNA, 20 bp, Artificial sequence
  Synthetic Oligonucleotide
atcacacataatttgaaatg

SEQ ID NO: 3488 - DNA, 20 bp, Artificial sequence
  Synthetic Oligonucleotide
agtataatacactgaaagct

SEQ ID NO: 3489 - DNA, 20 bp, Artificial sequence
  Synthetic Oligonucleotide
agctgtaaaaaagttaataa

SEQ ID NO: 3490 - DNA, 20 bp, Artificial sequence
  Synthetic Oligonucleotide
ttttcaaaccattatgccag

SEQ ID NO: 3491 - DNA, 20 bp, Artificial sequence
  Synthetic Oligonucleotide
aaacttaatgtgaaacagac

SEQ ID NO: 3492 - DNA, 20 bp, Artificial sequence
  Synthetic Oligonucleotide
gcaatgtttcaatatgctct

SEQ ID NO: 3493 - DNA, 20 bp, Artificial sequence
  Synthetic Oligonucleotide
gaatgaagccaagtgaataa

SEQ ID NO: 3494 - DNA, 20 bp, Artificial sequence
  Synthetic Oligonucleotide
agtgtcagatgcaatgtttt

SEQ ID NO: 3495 - DNA, 20 bp, Artificial sequence
  Synthetic Oligonucleotide
aggagaaaattacatcctaa

SEQ ID NO: 3496 - DNA, 20 bp, Artificial sequence
  Synthetic Oligonucleotide
aagaggaaatgtaccctgtg

SEQ ID NO: 3497 - DNA, 20 bp, Artificial sequence
  Synthetic Oligonucleotide
ctctctctcttgcaaaatta

SEQ ID NO: 3498 - DNA, 20 bp, Artificial sequence
  Synthetic Oligonucleotide
aattcaaaaggtcaaatttt

SEQ ID NO: 3499 - DNA, 20 bp, Artificial sequence
  Synthetic Oligonucleotide
ttgttttcataggcacagac

SEQ ID NO: 3500 - DNA, 20 bp, Artificial sequence
  Synthetic Oligonucleotide
ttcagtaataaaaagctggt

SEQ ID NO: 3501 - DNA, 20 bp, Artificial sequence
  Synthetic Oligonucleotide
caaggaattgcaagcataaa

SEQ ID NO: 3502 - DNA, 20 bp, Artificial sequence
  Synthetic Oligonucleotide
gtctaatattacacagcaaa

SEQ ID NO: 3503 - DNA, 20 bp, Artificial sequence
  Synthetic Oligonucleotide
atatttgctattcatggctc

SEQ ID NO: 3504 - DNA, 20 bp, Artificial sequence
  Synthetic Oligonucleotide
agcatattttttcttgataa

SEQ ID NO: 3505 - DNA, 20 bp, Artificial sequence
  Synthetic Oligonucleotide
taaaaatcaccaaatgtgga

SEQ ID NO: 3506 - DNA, 20 bp, Artificial sequence
  Synthetic Oligonucleotide
gataatatggtggacaaggt

SEQ ID NO: 3507 - DNA, 20 bp, Artificial sequence
  Synthetic Oligonucleotide
gattcattgatctgaggaga

SEQ ID NO: 3508 - DNA, 20 bp, Artificial sequence
  Synthetic Oligonucleotide
taaattgctatagccactac

SEQ ID NO: 3509 - DNA, 20 bp, Artificial sequence
  Synthetic Oligonucleotide
ttgccgacctaggactaaaa

SEQ ID NO: 3510 - DNA, 20 bp, Artificial sequence
  Synthetic Oligonucleotide
aaaaaatagaaagtcatcac

SEQ ID NO: 3511 - DNA, 20 bp, Artificial sequence
  Synthetic Oligonucleotide
ttcctctttcacatatactt

SEQ ID NO: 3512 - DNA, 20 bp, Artificial sequence
  Synthetic Oligonucleotide
taaactaccaattaaaattc

SEQ ID NO: 3513 - DNA, 20 bp, Artificial sequence
  Synthetic Oligonucleotide
gcacttaacaatatcatata

SEQ ID NO: 3514 - DNA, 20 bp, Artificial sequence
  Synthetic Oligonucleotide
cctgacattgccactcatga

SEQ ID NO: 3515 - DNA, 20 bp, Artificial sequence
  Synthetic Oligonucleotide
agctgggaaatggccatctt

SEQ ID NO: 3516 - DNA, 20 bp, Artificial sequence
  Synthetic Oligonucleotide
ctttcagccacttcaggaga

SEQ ID NO: 3517 - DNA, 20 bp, Artificial sequence
  Synthetic Oligonucleotide
tttaaccatatttagcttat

SEQ ID NO: 3518 - DNA, 20 bp, Artificial sequence
  Synthetic Oligonucleotide
gctgtcacctttcccaatgc

SEQ ID NO: 3519 - DNA, 20 bp, Artificial sequence
  Synthetic Oligonucleotide
aaggtctagtgatgtaatat

SEQ ID NO: 3520 - DNA, 20 bp, Artificial sequence
  Synthetic Oligonucleotide
ttttatttccttctaaaatg

SEQ ID NO: 3521 - DNA, 20 bp, Artificial sequence
  Synthetic Oligonucleotide
gcagtttctctactctagac

SEQ ID NO: 3522 - DNA, 20 bp, Artificial sequence
  Synthetic Oligonucleotide
tgagtactatagaattcctc

SEQ ID NO: 3523 - DNA, 20 bp, Artificial sequence
  Synthetic Oligonucleotide
cggtcaattacgggaaattc

SEQ ID NO: 3524 - DNA, 20 bp, Artificial sequence
  Synthetic Oligonucleotide
ctggaatttttctaggagct

SEQ ID NO: 3525 - DNA, 20 bp, Artificial sequence
  Synthetic Oligonucleotide
tgtggtccacaacttggccc

SEQ ID NO: 3526 - DNA, 20 bp, Artificial sequence
  Synthetic Oligonucleotide
tcggtaaactgatccaaaac

SEQ ID NO: 3527 - DNA, 20 bp, Artificial sequence
  Synthetic Oligonucleotide
actaattcagctgaattcaa

SEQ ID NO: 3528 - DNA, 20 bp, Artificial sequence
  Synthetic Oligonucleotide
taccaccactgttatgatgt

SEQ ID NO: 3529 - DNA, 20 bp, Artificial sequence
  Synthetic Oligonucleotide
tgcagatttctagaaaaatc

SEQ ID NO: 3530 - DNA, 20 bp, Artificial sequence
  Synthetic Oligonucleotide
tataaataaatttaaagttt

SEQ ID NO: 3531 - DNA, 20 bp, Artificial sequence
  Synthetic Oligonucleotide
aaagattgagatgcctcatg

SEQ ID NO: 3532 - DNA, 20 bp, Artificial sequence
  Synthetic Oligonucleotide
gtaggagacccctttctaca

SEQ ID NO: 3533 - DNA, 20 bp, Artificial sequence
  Synthetic Oligonucleotide
aatgaagctagaataataga

SEQ ID NO: 3534 - DNA, 20 bp, Artificial sequence
  Synthetic Oligonucleotide
gagtgatctaatacactcca

SEQ ID NO: 3535 - DNA, 20 bp, Artificial sequence
  Synthetic Oligonucleotide
ccgtcaaaaaaaaaatacct

SEQ ID NO: 3536 - DNA, 20 bp, Artificial sequence
  Synthetic Oligonucleotide
ctcgctgcaatacactttgt

SEQ ID NO: 3537 - DNA, 20 bp, Artificial sequence
  Synthetic Oligonucleotide
caaaacagaatatgaaccat

SEQ ID NO: 3538 - DNA, 20 bp, Artificial sequence
  Synthetic Oligonucleotide
tattgcctgaatttaaagag

SEQ ID NO: 3539 - DNA, 20 bp, Artificial sequence
  Synthetic Oligonucleotide
acttttaaatgcattgttgt

SEQ ID NO: 3540 - DNA, 20 bp, Artificial sequence
  Synthetic Oligonucleotide
tttaaagttgaaactcttaa

SEQ ID NO: 3541 - DNA, 20 bp, Artificial sequence
  Synthetic Oligonucleotide
tgaattaatatggcatttta

SEQ ID NO: 3542 - DNA, 20 bp, Artificial sequence
  Synthetic Oligonucleotide
aaacagaggaggaaagtgat

SEQ ID NO: 3543 - DNA, 20 bp, Artificial sequence
  Synthetic Oligonucleotide
tcagaggcaaaaaacaatat

SEQ ID NO: 3544 - DNA, 20 bp, Artificial sequence
  Synthetic Oligonucleotide
cgttgtgaaagagcaaaatt

SEQ ID NO: 3545 - DNA, 20 bp, Artificial sequence
  Synthetic Oligonucleotide
gtacaattcaaacaagagaa

SEQ ID NO: 3546 - DNA, 20 bp, Artificial sequence
  Synthetic Oligonucleotide
gaaatactgtattcaaaact

SEQ ID NO: 3547 - DNA, 20 bp, Artificial sequence
  Synthetic Oligonucleotide
gactgttactttctagaaat

SEQ ID NO: 3548 - DNA, 20 bp, Artificial sequence
  Synthetic Oligonucleotide
ggctaactggaaccagttat

SEQ ID NO: 3549 - DNA, 20 bp, Artificial sequence
  Synthetic Oligonucleotide
gactctgcttgttgtagtcc

SEQ ID NO: 3550 - DNA, 20 bp, Artificial sequence
  Synthetic Oligonucleotide
taatgtattgcattggtgct

SEQ ID NO: 3551 - DNA, 20 bp, Artificial sequence
  Synthetic Oligonucleotide
taaaaattatagtgccatcc

SEQ ID NO: 3552 - DNA, 20 bp, Artificial sequence
  Synthetic Oligonucleotide
aatgctacagcagagcaggc

SEQ ID NO: 3553 - DNA, 20 bp, Artificial sequence
  Synthetic Oligonucleotide
aactattggcaaacatagta

SEQ ID NO: 3554 - DNA, 20 bp, Artificial sequence
  Synthetic Oligonucleotide
catacagacctacaaaccat

SEQ ID NO: 3555 - DNA, 20 bp, Artificial sequence
  Synthetic Oligonucleotide
cataatatgtacaaaataca

SEQ ID NO: 3556 - DNA, 20 bp, Artificial sequence
  Synthetic Oligonucleotide
agtgatcctgaataattaac

SEQ ID NO: 3557 - DNA, 20 bp, Artificial sequence
  Synthetic Oligonucleotide
tttcttaagtgggatacaaa

SEQ ID NO: 3558 - DNA, 20 bp, Artificial sequence
  Synthetic Oligonucleotide
aattcttccagaggaagaaa

SEQ ID NO: 3559 - DNA, 20 bp, Artificial sequence
  Synthetic Oligonucleotide
attggagaataggttagaac

SEQ ID NO: 3560 - DNA, 20 bp, Artificial sequence
  Synthetic Oligonucleotide
gatctgtttccattgcctgc

SEQ ID NO: 3561 - DNA, 20 bp, Artificial sequence
  Synthetic Oligonucleotide
tgtccagtcattgaatgccg

SEQ ID NO: 3562 - DNA, 20 bp, Artificial sequence
  Synthetic Oligonucleotide
cttttaataaaagtgatgat

SEQ ID NO: 3563 - DNA, 20 bp, Artificial sequence
  Synthetic Oligonucleotide
acaacacactcaagatccaa

SEQ ID NO: 3564 - DNA, 20 bp, Artificial sequence
  Synthetic Oligonucleotide
aacagttaagaataatttga

SEQ ID NO: 3565 - DNA, 20 bp, Artificial sequence
  Synthetic Oligonucleotide
cactatttgaaaaaatgtct

SEQ ID NO: 3566 - DNA, 20 bp, Artificial sequence
  Synthetic Oligonucleotide
gactgccactgtactatttg

SEQ ID NO: 3567 - DNA, 20 bp, Artificial sequence
  Synthetic Oligonucleotide
gcaatcaaatgagttttcaa

SEQ ID NO: 3568 - DNA, 20 bp, Artificial sequence
  Synthetic Oligonucleotide
atcagtggcctattaaagaa

SEQ ID NO: 3569 - DNA, 20 bp, Artificial sequence
  Synthetic Oligonucleotide
tgcaatgtttcaatatgctc

SEQ ID NO: 3570 - DNA, 20 bp, Artificial sequence
  Synthetic Oligonucleotide
caatactccaaaaacatgca

SEQ ID NO: 3571 - DNA, 20 bp, Artificial sequence
  Synthetic Oligonucleotide
ttagttatgcatagacaaat

SEQ ID NO: 3572 - DNA, 20 bp, Artificial sequence
  Synthetic Oligonucleotide
atataattatgaaatctatt

SEQ ID NO: 3573 - DNA, 20 bp, Artificial sequence
  Synthetic Oligonucleotide
gagtatggattgtcatgtct

SEQ ID NO: 3574 - DNA, 20 bp, Artificial sequence
  Synthetic Oligonucleotide
acaaaaagtctttttgaggc

SEQ ID NO: 3575 - DNA, 20 bp, Artificial sequence
  Synthetic Oligonucleotide
ttactactatatatatatca

SEQ ID NO: 3576 - DNA, 20 bp, Artificial sequence
  Synthetic Oligonucleotide
catgtcagttggttagaact

SEQ ID NO: 3577 - DNA, 20 bp, Artificial sequence
  Synthetic Oligonucleotide
tattactacttgctatgagg

SEQ ID NO: 3578 - DNA, 20 bp, Artificial sequence
  Synthetic Oligonucleotide
atgagctctctaggcagaca

SEQ ID NO: 3579 - DNA, 20 bp, Artificial sequence
  Synthetic Oligonucleotide
agtctaatattacacagcaa

SEQ ID NO: 3580 - DNA, 20 bp, Artificial sequence
  Synthetic Oligonucleotide
tttttccaggtggaaatata

SEQ ID NO: 3581 - DNA, 20 bp, Artificial sequence
  Synthetic Oligonucleotide
attcaaaaactatttaaatg

SEQ ID NO: 3582 - DNA, 20 bp, Artificial sequence
  Synthetic Oligonucleotide
taatgagtacacagtaattc

SEQ ID NO: 3583 - DNA, 20 bp, Artificial sequence
  Synthetic Oligonucleotide
tcagataatatggtggacaa

SEQ ID NO: 3584 - DNA, 20 bp, Artificial sequence
  Synthetic Oligonucleotide
agaggccctacaaagattca

SEQ ID NO: 3585 - DNA, 20 bp, Artificial sequence
  Synthetic Oligonucleotide
tcaacaatatagagaggatc

SEQ ID NO: 3586 - DNA, 20 bp, Artificial sequence
  Synthetic Oligonucleotide
tgtatttaatagaaaatagt

SEQ ID NO: 3587 - DNA, 20 bp, Artificial sequence
  Synthetic Oligonucleotide
tgaagtgcaaagataattct

SEQ ID NO: 3588 - DNA, 20 bp, Artificial sequence
  Synthetic Oligonucleotide
ctgagacaacctattgagag

SEQ ID NO: 3589 - DNA, 20 bp, Artificial sequence
  Synthetic Oligonucleotide
catatcacttgtaattttga

SEQ ID NO: 3590 - DNA, 20 bp, Artificial sequence
  Synthetic Oligonucleotide
acgcacttaacaatatcata

SEQ ID NO: 3591 - DNA, 20 bp, Artificial sequence
  Synthetic Oligonucleotide
ttccaccacaatattataac

SEQ ID NO: 3592 - DNA, 20 bp, Artificial sequence
  Synthetic Oligonucleotide
ctatgagctgggaaatggcc

SEQ ID NO: 3593 - DNA, 20 bp, Artificial sequence
  Synthetic Oligonucleotide
actttcagccacttcaggag

SEQ ID NO: 3594 - DNA, 20 bp, Artificial sequence
  Synthetic Oligonucleotide
cattcttgaaacactgtttt

SEQ ID NO: 3595 - DNA, 20 bp, Artificial sequence
  Synthetic Oligonucleotide
tggctgtcacctttcccaat

SEQ ID NO: 3596 - DNA, 20 bp, Artificial sequence
  Synthetic Oligonucleotide
ctccagcttttcaagatgct

SEQ ID NO: 3597 - DNA, 20 bp, Artificial sequence
  Synthetic Oligonucleotide
atgaaatgtggttcttacta

SEQ ID NO: 3598 - DNA, 20 bp, Artificial sequence
  Synthetic Oligonucleotide
tgcagtttctctactctaga

SEQ ID NO: 3599 - DNA, 20 bp, Artificial sequence
  Synthetic Oligonucleotide
atgagtactatagaattcct

SEQ ID NO: 3600 - DNA, 20 bp, Artificial sequence
  Synthetic Oligonucleotide
tccggtcaattacgggaaat

SEQ ID NO: 3601 - DNA, 20 bp, Artificial sequence
  Synthetic Oligonucleotide
aatgtggtccacaacttggc

SEQ ID NO: 3602 - DNA, 20 bp, Artificial sequence
  Synthetic Oligonucleotide
gctgctcggtaaactgatcc

SEQ ID NO: 3603 - DNA, 20 bp, Artificial sequence
  Synthetic Oligonucleotide
tgcttgcattcctgctgttg

SEQ ID NO: 3604 - DNA, 20 bp, Artificial sequence
  Synthetic Oligonucleotide
aacagggctattttgcttag

SEQ ID NO: 3605 - DNA, 20 bp, Artificial sequence
  Synthetic Oligonucleotide
tacattacatgggaaactgt

SEQ ID NO: 3606 - DNA, 20 bp, Artificial sequence
  Synthetic Oligonucleotide
aatacagaaaatctttcatc

SEQ ID NO: 3607 - DNA, 20 bp, Artificial sequence
  Synthetic Oligonucleotide
atcaggcacttctgaacacc

SEQ ID NO: 3608 - DNA, 20 bp, Artificial sequence
  Synthetic Oligonucleotide
agtgagtattaaaatgtcag

SEQ ID NO: 3609 - DNA, 20 bp, Artificial sequence
  Synthetic Oligonucleotide
tgctccccaagtaatgaagc

SEQ ID NO: 3610 - DNA, 20 bp, Artificial sequence
  Synthetic Oligonucleotide
gattttaatccctatgttat

SEQ ID NO: 3611 - DNA, 20 bp, Artificial sequence
  Synthetic Oligonucleotide
acttcaatatattccagtgt

SEQ ID NO: 3612 - DNA, 20 bp, Artificial sequence
  Synthetic Oligonucleotide
tgctattctgacttttgaca

SEQ ID NO: 3613 - DNA, 20 bp, Artificial sequence
  Synthetic Oligonucleotide
gttaatggtcacttacaaaa

SEQ ID NO: 3614 - DNA, 20 bp, Artificial sequence
  Synthetic Oligonucleotide
gacactccttttaaaagtcc

SEQ ID NO: 3615 - DNA, 20 bp, Artificial sequence
  Synthetic Oligonucleotide
ttcagcaaccactctcactt

SEQ ID NO: 3616 - DNA, 20 bp, Artificial sequence
  Synthetic Oligonucleotide
ttcattgtgtaaaataactt

SEQ ID NO: 3617 - DNA, 20 bp, Artificial sequence
  Synthetic Oligonucleotide
atcacagatggctctgcaat

SEQ ID NO: 3618 - DNA, 20 bp, Artificial sequence
  Synthetic Oligonucleotide
ataatagacaattttaccag

SEQ ID NO: 3619 - DNA, 20 bp, Artificial sequence
  Synthetic Oligonucleotide
agaacattttacacactatc

SEQ ID NO: 3620 - DNA, 20 bp, Artificial sequence
  Synthetic Oligonucleotide
ctatataatcttagcatctc

SEQ ID NO: 3621 - DNA, 20 bp, Artificial sequence
  Synthetic Oligonucleotide
cattgaggtaaatgagtaca

SEQ ID NO: 3622 - DNA, 20 bp, Artificial sequence
  Synthetic Oligonucleotide
ttgatacctagaatgatacg

SEQ ID NO: 3623 - DNA, 20 bp, Artificial sequence
  Synthetic Oligonucleotide
atagtataaatacagaaaac

SEQ ID NO: 3624 - DNA, 20 bp, Artificial sequence
  Synthetic Oligonucleotide
ttggctaactggaaccagtt

SEQ ID NO: 3625 - DNA, 20 bp, Artificial sequence
  Synthetic Oligonucleotide
ggaaggaaaaaacgaatacc

SEQ ID NO: 3626 - DNA, 20 bp, Artificial sequence
  Synthetic Oligonucleotide
atcttgaaatagtaatgtat

SEQ ID NO: 3627 - DNA, 20 bp, Artificial sequence
  Synthetic Oligonucleotide
tgggacttgaatataaatgt

SEQ ID NO: 3628 - DNA, 20 bp, Artificial sequence
  Synthetic Oligonucleotide
ttgataagcaaagtagcctt

SEQ ID NO: 3629 - DNA, 20 bp, Artificial sequence
  Synthetic Oligonucleotide
taaactattggcaaacatag

SEQ ID NO: 3630 - DNA, 20 bp, Artificial sequence
  Synthetic Oligonucleotide
aggtgatttatgttttactc

SEQ ID NO: 3631 - DNA, 20 bp, Artificial sequence
  Synthetic Oligonucleotide
tcagaagatggtaacttacc

SEQ ID NO: 3632 - DNA, 20 bp, Artificial sequence
  Synthetic Oligonucleotide
taagagatacaccagcaact

SEQ ID NO: 3633 - DNA, 20 bp, Artificial sequence
  Synthetic Oligonucleotide
ggtttcttaagtgggataca

SEQ ID NO: 3634 - DNA, 20 bp, Artificial sequence
  Synthetic Oligonucleotide
tacataagaagaaatttaaa

SEQ ID NO: 3635 - DNA, 20 bp, Artificial sequence
  Synthetic Oligonucleotide
attaacacaaaacaaccctc

SEQ ID NO: 3636 - DNA, 20 bp, Artificial sequence
  Synthetic Oligonucleotide
cagatctgtttccattgcct

SEQ ID NO: 3637 - DNA, 20 bp, Artificial sequence
  Synthetic Oligonucleotide
agcaaacccctacttacaca

SEQ ID NO: 3638 - DNA, 20 bp, Artificial sequence
  Synthetic Oligonucleotide
tctacaacttttaataaaag

SEQ ID NO: 3639 - DNA, 20 bp, Artificial sequence
  Synthetic Oligonucleotide
aaagataaatttacacatat

SEQ ID NO: 3640 - DNA, 20 bp, Artificial sequence
  Synthetic Oligonucleotide
agaatttttatccttatact

SEQ ID NO: 3641 - DNA, 20 bp, Artificial sequence
  Synthetic Oligonucleotide
ccactatttgaaaaaatgtc

SEQ ID NO: 3642 - DNA, 20 bp, Artificial sequence
  Synthetic Oligonucleotide
attcactcctaaataaaata

SEQ ID NO: 3643 - DNA, 20 bp, Artificial sequence
  Synthetic Oligonucleotide
atgatctctaatagattaaa

SEQ ID NO: 3644 - DNA, 20 bp, Artificial sequence
  Synthetic Oligonucleotide
acatgatttgtcatgaacac

SEQ ID NO: 3645 - DNA, 20 bp, Artificial sequence
  Synthetic Oligonucleotide
taagtgctctgggtcacact

SEQ ID NO: 3646 - DNA, 20 bp, Artificial sequence
  Synthetic Oligonucleotide
agcaccaatactccaaaaac

SEQ ID NO: 3647 - DNA, 20 bp, Artificial sequence
  Synthetic Oligonucleotide
attagttatgcatagacaaa

SEQ ID NO: 3648 - DNA, 20 bp, Artificial sequence
  Synthetic Oligonucleotide
aatctatgacaatataatta

SEQ ID NO: 3649 - DNA, 20 bp, Artificial sequence
  Synthetic Oligonucleotide
atatggagtatggattgtca

SEQ ID NO: 3650 - DNA, 20 bp, Artificial sequence
  Synthetic Oligonucleotide
actagtttttattctacctt

SEQ ID NO: 3651 - DNA, 20 bp, Artificial sequence
  Synthetic Oligonucleotide
ctaacatatactcttggagc

SEQ ID NO: 3652 - DNA, 20 bp, Artificial sequence
  Synthetic Oligonucleotide
aatcttttttttaatgccca

SEQ ID NO: 3653 - DNA, 20 bp, Artificial sequence
  Synthetic Oligonucleotide
tgatgggttctagagcagaa

SEQ ID NO: 3654 - DNA, 20 bp, Artificial sequence
  Synthetic Oligonucleotide
gctaacacttcatgacacac

SEQ ID NO: 3655 - DNA, 20 bp, Artificial sequence
  Synthetic Oligonucleotide
agcatcaaaaattctgtgct

SEQ ID NO: 3656 - DNA, 20 bp, Artificial sequence
  Synthetic Oligonucleotide
gtggtccagtccaccttcat

SEQ ID NO: 3657 - DNA, 20 bp, Artificial sequence
  Synthetic Oligonucleotide
ttatgcttcccttcttagaa

SEQ ID NO: 3658 - DNA, 20 bp, Artificial sequence
  Synthetic Oligonucleotide
aaaacattccaggataatga

SEQ ID NO: 3659 - DNA, 20 bp, Artificial sequence
  Synthetic Oligonucleotide
taaaacatgacaagagttct

SEQ ID NO: 3660 - DNA, 20 bp, Artificial sequence
  Synthetic Oligonucleotide
tcttaatttggtagttagat

SEQ ID NO: 3661 - DNA, 20 bp, Artificial sequence
  Synthetic Oligonucleotide
gatgaaagtaggccccactc

SEQ ID NO: 3662 - DNA, 20 bp, Artificial sequence
  Synthetic Oligonucleotide
tgtcagagagccactacgct

SEQ ID NO: 3663 - DNA, 20 bp, Artificial sequence
  Synthetic Oligonucleotide
ttctctattcagaggcagaa

SEQ ID NO: 3664 - DNA, 20 bp, Artificial sequence
  Synthetic Oligonucleotide
ttcaactagagaatgcaaca

SEQ ID NO: 3665 - DNA, 20 bp, Artificial sequence
  Synthetic Oligonucleotide
aaagatccatcataaaacat

SEQ ID NO: 3666 - DNA, 20 bp, Artificial sequence
  Synthetic Oligonucleotide
ttaacaatatcatataatct

SEQ ID NO: 3667 - DNA, 20 bp, Artificial sequence
  Synthetic Oligonucleotide
tgccactcatgaggacttcc

SEQ ID NO: 3668 - DNA, 20 bp, Artificial sequence
  Synthetic Oligonucleotide
taaggagattatttagtgcc

SEQ ID NO: 3669 - DNA, 20 bp, Artificial sequence
  Synthetic Oligonucleotide
tcagccacttcaggagaatg

SEQ ID NO: 3670 - DNA, 20 bp, Artificial sequence
  Synthetic Oligonucleotide
accatatttagcttatgatg

SEQ ID NO: 3671 - DNA, 20 bp, Artificial sequence
  Synthetic Oligonucleotide
tcacctttcccaatgcttat

SEQ ID NO: 3672 - DNA, 20 bp, Artificial sequence
  Synthetic Oligonucleotide
aaatcttcatgatcaaaaat

SEQ ID NO: 3673 - DNA, 20 bp, Artificial sequence
  Synthetic Oligonucleotide
gtaggatctaaaaccactga

SEQ ID NO: 3674 - DNA, 20 bp, Artificial sequence
  Synthetic Oligonucleotide
tctagaccataaatatgctt

SEQ ID NO: 3675 - DNA, 20 bp, Artificial sequence
  Synthetic Oligonucleotide
tactatagaattcctcacga

SEQ ID NO: 3676 - DNA, 20 bp, Artificial sequence
  Synthetic Oligonucleotide
attcaattggcacattttta

SEQ ID NO: 3677 - DNA, 20 bp, Artificial sequence
  Synthetic Oligonucleotide
aatttttctaggagcttaaa

SEQ ID NO: 3678 - DNA, 20 bp, Artificial sequence
  Synthetic Oligonucleotide
gtccacaacttggcccaaaa

SEQ ID NO: 3679 - DNA, 20 bp, Artificial sequence
  Synthetic Oligonucleotide
caggtcagccaaaatcaagt

SEQ ID NO: 3680 - DNA, 20 bp, Artificial sequence
  Synthetic Oligonucleotide
tttcttgaggattttctttc

SEQ ID NO: 3681 - DNA, 20 bp, Artificial sequence
  Synthetic Oligonucleotide
attacatttctttccgttga

SEQ ID NO: 3682 - DNA, 20 bp, Artificial sequence
  Synthetic Oligonucleotide
aaattatcggccttataaat

SEQ ID NO: 3683 - DNA, 20 bp, Artificial sequence
  Synthetic Oligonucleotide
ggccaaagaatttaccgaaa

SEQ ID NO: 3684 - DNA, 20 bp, Artificial sequence
  Synthetic Oligonucleotide
tttttaaggccccctttaaa

SEQ ID NO: 3685 - DNA, 20 bp, Artificial sequence
  Synthetic Oligonucleotide
ttaggtctgtcacaagctct

SEQ ID NO: 3686 - DNA, 20 bp, Artificial sequence
  Synthetic Oligonucleotide
cagtctgtttacaagatgcc

SEQ ID NO: 3687 - DNA, 20 bp, Artificial sequence
  Synthetic Oligonucleotide
tgaacagttggtttgtacag

SEQ ID NO: 3688 - DNA, 20 bp, Artificial sequence
  Synthetic Oligonucleotide
ggactgatgaggacaattca

SEQ ID NO: 3689 - DNA, 20 bp, Artificial sequence
  Synthetic Oligonucleotide
aggtgatctatcccattctg

SEQ ID NO: 3690 - DNA, 20 bp, Artificial sequence
  Synthetic Oligonucleotide
gtggctaaatttcaaagcct

SEQ ID NO: 3691 - DNA, 20 bp, Artificial sequence
  Synthetic Oligonucleotide
tggaaatgtaatgtattggt

SEQ ID NO: 3692 - DNA, 20 bp, Artificial sequence
  Synthetic Oligonucleotide
gcagttggtttagactcccc

SEQ ID NO: 3693 - DNA, 20 bp, Artificial sequence
  Synthetic Oligonucleotide
aggaaaaactttacctgata

SEQ ID NO: 3694 - DNA, 20 bp, Artificial sequence
  Synthetic Oligonucleotide
attttctatcatataaaatc

SEQ ID NO: 3695 - DNA, 20 bp, Artificial sequence
  Synthetic Oligonucleotide
taaaattttgtatatgtcat

SEQ ID NO: 3696 - DNA, 20 bp, Artificial sequence
  Synthetic Oligonucleotide
aggtcttactcaatagtcac

SEQ ID NO: 3697 - DNA, 20 bp, Artificial sequence
  Synthetic Oligonucleotide
ctgaaattaactgagatttt

SEQ ID NO: 3698 - DNA, 20 bp, Artificial sequence
  Synthetic Oligonucleotide
tataaaaattaatctaagtg

SEQ ID NO: 3699 - DNA, 20 bp, Artificial sequence
  Synthetic Oligonucleotide
ctgattgaatagccaccaga

SEQ ID NO: 3700 - DNA, 20 bp, Artificial sequence
  Synthetic Oligonucleotide
aagctcagagttacttggac

SEQ ID NO: 3701 - DNA, 20 bp, Artificial sequence
  Synthetic Oligonucleotide
gacgcggcaactgtggcaat

SEQ ID NO: 3702 - DNA, 20 bp, Artificial sequence
  Synthetic Oligonucleotide
atgaatgattaccatgtaag

SEQ ID NO: 3703 - DNA, 20 bp, Artificial sequence
  Synthetic Oligonucleotide
tccaacatcatatgactgat

SEQ ID NO: 3704 - DNA, 20 bp, Artificial sequence
  Synthetic Oligonucleotide
cagtttctcaccctgtgtcc

SEQ ID NO: 3705 - DNA, 20 bp, Artificial sequence
  Synthetic Oligonucleotide
agttacaaaaaatatttcct

SEQ ID NO: 3706 - DNA, 20 bp, Artificial sequence
  Synthetic Oligonucleotide
gaattatattttgaagggag

SEQ ID NO: 3707 - DNA, 20 bp, Artificial sequence
  Synthetic Oligonucleotide
ccattttatattctctatta

SEQ ID NO: 3708 - DNA, 20 bp, Artificial sequence
  Synthetic Oligonucleotide
tacatgtaagcatataaaaa

SEQ ID NO: 3709 - DNA, 20 bp, Artificial sequence
  Synthetic Oligonucleotide
cctgatggaatttcaaagtt

SEQ ID NO: 3710 - DNA, 20 bp, Artificial sequence
  Synthetic Oligonucleotide
ttaagtgggatacaaaaagc

SEQ ID NO: 3711 - DNA, 20 bp, Artificial sequence
  Synthetic Oligonucleotide
atatttctctatcaaataca

SEQ ID NO: 3712 - DNA, 20 bp, Artificial sequence
  Synthetic Oligonucleotide
ggctcccaatttcctcaact

SEQ ID NO: 3713 - DNA, 20 bp, Artificial sequence
  Synthetic Oligonucleotide
tgtttccattgcctgccctc

SEQ ID NO: 3714 - DNA, 20 bp, Artificial sequence
  Synthetic Oligonucleotide
aattgaaggattaccaagtt

SEQ ID NO: 3715 - DNA, 20 bp, Artificial sequence
  Synthetic Oligonucleotide
tgcatgtttagtttaagact

SEQ ID NO: 3716 - DNA, 20 bp, Artificial sequence
  Synthetic Oligonucleotide
gtttttacacaatgatccac

SEQ ID NO: 3717 - DNA, 20 bp, Artificial sequence
  Synthetic Oligonucleotide
tcatgaaattggtatttaga

SEQ ID NO: 3718 - DNA, 20 bp, Artificial sequence
  Synthetic Oligonucleotide
agagattttaggcagaagag

SEQ ID NO: 3719 - DNA, 20 bp, Artificial sequence
  Synthetic Oligonucleotide
tgtatgcagccaattacatg

SEQ ID NO: 3720 - DNA, 20 bp, Artificial sequence
  Synthetic Oligonucleotide
aaaccattatgccagaatgc

SEQ ID NO: 3721 - DNA, 20 bp, Artificial sequence
  Synthetic Oligonucleotide
cttttggatattattatatt

SEQ ID NO: 3722 - DNA, 20 bp, Artificial sequence
  Synthetic Oligonucleotide
aataattttaggaactcggg

SEQ ID NO: 3723 - DNA, 20 bp, Artificial sequence
  Synthetic Oligonucleotide
acattatcttgactttatca

SEQ ID NO: 3724 - DNA, 20 bp, Artificial sequence
  Synthetic Oligonucleotide
tagactacagttagtttgac

SEQ ID NO: 3725 - DNA, 20 bp, Artificial sequence
  Synthetic Oligonucleotide
attacctaggagaaactctg

SEQ ID NO: 3726 - DNA, 20 bp, Artificial sequence
  Synthetic Oligonucleotide
ttctgtaaatgaacatggga

SEQ ID NO: 3727 - DNA, 20 bp, Artificial sequence
  Synthetic Oligonucleotide
ctctcctgttcagaaacaaa

SEQ ID NO: 3728 - DNA, 20 bp, Artificial sequence
  Synthetic Oligonucleotide
gagggcgaggaaactaactc

SEQ ID NO: 3729 - DNA, 20 bp, Artificial sequence
  Synthetic Oligonucleotide
caccattcccttagtttgcc

SEQ ID NO: 3730 - DNA, 20 bp, Artificial sequence
  Synthetic Oligonucleotide
aagtgcatgagtccacatat

SEQ ID NO: 3731 - DNA, 20 bp, Artificial sequence
  Synthetic Oligonucleotide
tagagtcaaggacctggtgg

SEQ ID NO: 3732 - DNA, 20 bp, Artificial sequence
  Synthetic Oligonucleotide
cttctgtttgagtatataat

SEQ ID NO: 3733 - DNA, 20 bp, Artificial sequence
  Synthetic Oligonucleotide
ttagagttgcatatggttta

SEQ ID NO: 3734 - DNA, 20 bp, Artificial sequence
  Synthetic Oligonucleotide
atttggaatcacaggctctt

SEQ ID NO: 3735 - DNA, 20 bp, Artificial sequence
  Synthetic Oligonucleotide
ttatgcactaaacaaaaaaa

SEQ ID NO: 3736 - DNA, 20 bp, Artificial sequence
  Synthetic Oligonucleotide
tgggaccccaaaggactgca

SEQ ID NO: 3737 - DNA, 20 bp, Artificial sequence
  Synthetic Oligonucleotide
tttatttaattttcagcaat

SEQ ID NO: 3738 - DNA, 20 bp, Artificial sequence
  Synthetic Oligonucleotide
atatcaaagggattcctata

SEQ ID NO: 3739 - DNA, 20 bp, Artificial sequence
  Synthetic Oligonucleotide
cctctcagtcggtgtgtact

SEQ ID NO: 3740 - DNA, 20 bp, Artificial sequence
  Synthetic Oligonucleotide
tagactattgcaattatttc

SEQ ID NO: 3741 - DNA, 20 bp, Artificial sequence
  Synthetic Oligonucleotide
tattttcttcaccatgttca

SEQ ID NO: 3742 - DNA, 20 bp, Artificial sequence
  Synthetic Oligonucleotide
taccatatgtaatattttct

SEQ ID NO: 3743 - DNA, 20 bp, Artificial sequence
  Synthetic Oligonucleotide
cctgctgcacactcgcgact

SEQ ID NO: 3744 - DNA, 20 bp, Artificial sequence
  Synthetic Oligonucleotide
cttccacattattgcaagga

SEQ ID NO: 3745 - DNA, 20 bp, Artificial sequence
  Synthetic Oligonucleotide
gctgcattctctgggtactg

SEQ ID NO: 3746 - DNA, 20 bp, Artificial sequence
  Synthetic Oligonucleotide
aatgtatatgcttctgcatt

SEQ ID NO: 3747 - DNA, 20 bp, Artificial sequence
  Synthetic Oligonucleotide
tttacagccactttcagcca

SEQ ID NO: 3748 - DNA, 20 bp, Artificial sequence
  Synthetic Oligonucleotide
atcctttagtctgtatttca

SEQ ID NO: 3749 - DNA, 20 bp, Artificial sequence
  Synthetic Oligonucleotide
gacagcacatcttcagaaaa

SEQ ID NO: 3750 - DNA, 20 bp, Artificial sequence
  Synthetic Oligonucleotide
aaatgtgtcaaactcttcag

SEQ ID NO: 3751 - DNA, 20 bp, Artificial sequence
  Synthetic Oligonucleotide
tgcgggacctggtaggtact

SEQ ID NO: 3752 - DNA, 20 bp, Artificial sequence
  Synthetic Oligonucleotide
cccatttcattgggaaagga

SEQ ID NO: 3753 - DNA, 20 bp, Artificial sequence
  Synthetic Oligonucleotide
agttccttggtgattttact

SEQ ID NO: 3754 - DNA, 20 bp, Artificial sequence
  Synthetic Oligonucleotide
attttacaaagccacttggg

SEQ ID NO: 3755 - DNA, 20 bp, Artificial sequence
  Synthetic Oligonucleotide
ggcatttcatatagtcggat

SEQ ID NO: 3756 - DNA, 20 bp, Artificial sequence
  Synthetic Oligonucleotide
gccttggttgatctggattt

SEQ ID NO: 3757 - DNA, 20 bp, Artificial sequence
  Synthetic Oligonucleotide
gtgcaatcctgtgctgtagg

SEQ ID NO: 3758 - DNA, 20 bp, Artificial sequence
  Synthetic Oligonucleotide
tactatcagcaacttcctca

SEQ ID NO: 3759 - DNA, 20 bp, Artificial sequence
  Synthetic Oligonucleotide
cgtataagtcgacgagttga

SEQ ID NO: 3760 - DNA, 20 bp, Artificial sequence
  Synthetic Oligonucleotide
tcagggtatccacattcaaa

SEQ ID NO: 3761 - DNA, 20 bp, Artificial sequence
  Synthetic Oligonucleotide
ttacctgctgcacactcgcg

SEQ ID NO: 3762 - DNA, 20 bp, Artificial sequence
  Synthetic Oligonucleotide
tccttattttccagcatact

SEQ ID NO: 3763 - DNA, 20 bp, Artificial sequence
  Synthetic Oligonucleotide
tctctctaagagagaaggtt

SEQ ID NO: 3764 - DNA, 20 bp, Artificial sequence
  Synthetic Oligonucleotide
cttcatggtttgaattcaaa

SEQ ID NO: 3765 - DNA, 20 bp, Artificial sequence
  Synthetic Oligonucleotide
aaatcatcaattgtatacct

SEQ ID NO: 3766 - DNA, 20 bp, Artificial sequence
  Synthetic Oligonucleotide
ctcaatcagtacttctagcc

SEQ ID NO: 3767 - DNA, 20 bp, Artificial sequence
  Synthetic Oligonucleotide
agtttatctagcttgagaat

SEQ ID NO: 3768 - DNA, 20 bp, Artificial sequence
  Synthetic Oligonucleotide
aaaccatggcctttctctat

SEQ ID NO: 3769 - DNA, 20 bp, Artificial sequence
  Synthetic Oligonucleotide
ccaaaacattattatccaga

SEQ ID NO: 3770 - DNA, 20 bp, Artificial sequence
  Synthetic Oligonucleotide
agaaatttgggttctcagcc

SEQ ID NO: 3771 - DNA, 20 bp, Artificial sequence
  Synthetic Oligonucleotide
aaatgcctctgtaagaatcc

SEQ ID NO: 3772 - DNA, 20 bp, Artificial sequence
  Synthetic Oligonucleotide
aagtgaggagaagagaatgg

SEQ ID NO: 3773 - DNA, 20 bp, Artificial sequence
  Synthetic Oligonucleotide
tctaaaggtgccccaacaga

SEQ ID NO: 3774 - DNA, 20 bp, Artificial sequence
  Synthetic Oligonucleotide
atcacatacacattctaaaa

SEQ ID NO: 3775 - DNA, 20 bp, Artificial sequence
  Synthetic Oligonucleotide
atagattagttagactgatg

SEQ ID NO: 3776 - DNA, 20 bp, Artificial sequence
  Synthetic Oligonucleotide
ttctgcttgaaatgtcttcc

SEQ ID NO: 3777 - DNA, 20 bp, Artificial sequence
  Synthetic Oligonucleotide
tctttgttctatcacttgag

SEQ ID NO: 3778 - DNA, 20 bp, Artificial sequence
  Synthetic Oligonucleotide
ccttcttctctttttcatac

SEQ ID NO: 3779 - DNA, 20 bp, Artificial sequence
  Synthetic Oligonucleotide
taaaaatttagtccttcatc

SEQ ID NO: 3780 - DNA, 20 bp, Artificial sequence
  Synthetic Oligonucleotide
agggtgcatagtctgtaggt

SEQ ID NO: 3781 - DNA, 20 bp, Artificial sequence
  Synthetic Oligonucleotide
ctgtttggcaggcaaggcca

SEQ ID NO: 3782 - DNA, 20 bp, Artificial sequence
  Synthetic Oligonucleotide
attctaaatcctgaattcaa

SEQ ID NO: 3783 - DNA, 20 bp, Artificial sequence
  Synthetic Oligonucleotide
aggatgttcatttaactata

SEQ ID NO: 3784 - DNA, 20 bp, Artificial sequence
  Synthetic Oligonucleotide
gaatatggaaagaggaataa

SEQ ID NO: 3785 - DNA, 20 bp, Artificial sequence
  Synthetic Oligonucleotide
tccatcagttactgtgctaa

SEQ ID NO: 3786 - DNA, 20 bp, Artificial sequence
  Synthetic Oligonucleotide
gaagagagaatttagagcta

SEQ ID NO: 3787 - DNA, 20 bp, Artificial sequence
  Synthetic Oligonucleotide
aaagcccctcactccatttt

SEQ ID NO: 3788 - DNA, 20 bp, Artificial sequence
  Synthetic Oligonucleotide
aagttagttgattaaaaatt

SEQ ID NO: 3789 - DNA, 20 bp, Artificial sequence
  Synthetic Oligonucleotide
ataaatttggctggcaataa

SEQ ID NO: 3790 - DNA, 20 bp, Artificial sequence
  Synthetic Oligonucleotide
gttaatggtatttataatta

SEQ ID NO: 3791 - DNA, 20 bp, Artificial sequence
  Synthetic Oligonucleotide
attttcagagagctatccta

SEQ ID NO: 3792 - DNA, 20 bp, Artificial sequence
  Synthetic Oligonucleotide
ctttcttacccttctaaaat

SEQ ID NO: 3793 - DNA, 20 bp, Artificial sequence
  Synthetic Oligonucleotide
ctgagatgacacactgacca

SEQ ID NO: 3794 - DNA, 20 bp, Artificial sequence
  Synthetic Oligonucleotide
ctcttcaagacattgaaagt

SEQ ID NO: 3795 - DNA, 20 bp, Artificial sequence
  Synthetic Oligonucleotide
gaaatgaagggctttggaat

SEQ ID NO: 3796 - DNA, 20 bp, Artificial sequence
  Synthetic Oligonucleotide
ataagaagttgaatcagaaa

SEQ ID NO: 3797 - DNA, 20 bp, Artificial sequence
  Synthetic Oligonucleotide
ctcttaacccagagaattag

SEQ ID NO: 3798 - DNA, 20 bp, Artificial sequence
  Synthetic Oligonucleotide
acagagcatatttcacacat

SEQ ID NO: 3799 - DNA, 20 bp, Artificial sequence
  Synthetic Oligonucleotide
ccacagaatcttcaggaatt

SEQ ID NO: 3800 - DNA, 20 bp, Artificial sequence
  Synthetic Oligonucleotide
ttggataaattattcaacct

SEQ ID NO: 3801 - DNA, 20 bp, Artificial sequence
  Synthetic Oligonucleotide
tgatcatgctaaacgcaaaa

SEQ ID NO: 3802 - DNA, 20 bp, Artificial sequence
  Synthetic Oligonucleotide
gaatattgaaacatggttac

SEQ ID NO: 3803 - DNA, 20 bp, Artificial sequence
  Synthetic Oligonucleotide
tcttggtattctctcattct

SEQ ID NO: 3804 - DNA, 20 bp, Artificial sequence
  Synthetic Oligonucleotide
ttacaacacactatgtatca

SEQ ID NO: 3805 - DNA, 20 bp, Artificial sequence
  Synthetic Oligonucleotide
attaaaccaatataccaagg

SEQ ID NO: 3806 - DNA, 20 bp, Artificial sequence
  Synthetic Oligonucleotide
gcaattcaaaaaaagtccga

SEQ ID NO: 3807 - DNA, 20 bp, Artificial sequence
  Synthetic Oligonucleotide
tgagagaaattgttagaagc

SEQ ID NO: 3808 - DNA, 20 bp, Artificial sequence
  Synthetic Oligonucleotide
tttatagaacacagactctt

SEQ ID NO: 3809 - DNA, 20 bp, Artificial sequence
  Synthetic Oligonucleotide
agggaggtaagattccacag

SEQ ID NO: 3810 - DNA, 20 bp, Artificial sequence
  Synthetic Oligonucleotide
catatgtcagagggtcctaa

SEQ ID NO: 3811 - DNA, 20 bp, Artificial sequence
  Synthetic Oligonucleotide
tttgctaaaattatctgtgc

SEQ ID NO: 3812 - DNA, 20 bp, Artificial sequence
  Synthetic Oligonucleotide
gatggtgaaaattataggag

SEQ ID NO: 3813 - DNA, 20 bp, Artificial sequence
  Synthetic Oligonucleotide
aaaaacccttgggccaacaa

SEQ ID NO: 3814 - DNA, 20 bp, Artificial sequence
  Synthetic Oligonucleotide
ccctgctgtgataggcttga

SEQ ID NO: 3815 - DNA, 20 bp, Artificial sequence
  Synthetic Oligonucleotide
ttgaaagaggtttatattaa

SEQ ID NO: 3816 - DNA, 20 bp, Artificial sequence
  Synthetic Oligonucleotide
ggtgtcactgtcatattata

SEQ ID NO: 3817 - DNA, 20 bp, Artificial sequence
  Synthetic Oligonucleotide
atagtctaattcatgacaaa

SEQ ID NO: 3818 - DNA, 20 bp, Artificial sequence
  Synthetic Oligonucleotide
ctatgtaggccctaggctag

SEQ ID NO: 3819 - DNA, 17 bp, Artificial sequence
  Synthetic Oligonucleotide
ccctttccatgtgaaca

SEQ ID NO: 3820 - DNA, 20 bp, Artificial sequence
  Synthetic Oligonucleotide
catatctaaagaccgcaagc

SEQ ID NO: 3821 - DNA, 20 bp, Artificial sequence
  Synthetic Oligonucleotide
gttccttcagtctcaagggg

SEQ ID NO: 3822 - DNA, 20 bp, Artificial sequence
  Synthetic Oligonucleotide
ttccttcagtctcaaggggg

SEQ ID NO: 3823 - DNA, 20 bp, Artificial sequence
  Synthetic Oligonucleotide
tccttcagtctcaaggggga

SEQ ID NO: 3824 - DNA, 20 bp, Artificial sequence
  Synthetic Oligonucleotide
tcataagtttcattcggtta

SEQ ID NO: 3825 - DNA, 20 bp, Artificial sequence
  Synthetic Oligonucleotide
ctttctcacatacctattaa

SEQ ID NO: 3826 - DNA, 20 bp, Artificial sequence
  Synthetic Oligonucleotide
tctttctcacatacctatta

SEQ ID NO: 3827 - DNA, 20 bp, Artificial sequence
  Synthetic Oligonucleotide
ctctttctcacatacctatt

SEQ ID NO: 3828 - DNA, 20 bp, Artificial sequence
  Synthetic Oligonucleotide
tctctttctcacatacctat

SEQ ID NO: 3829 - DNA, 17 bp, Artificial sequence
  Synthetic Oligonucleotide
taacaatatcatataat

SEQ ID NO: 3830 - DNA, 17 bp, Artificial sequence
  Synthetic Oligonucleotide
ttaacaatatcatataa

SEQ ID NO: 3831 - DNA, 17 bp, Artificial sequence
  Synthetic Oligonucleotide
cttaacaatatcatata

SEQ ID NO: 3832 - DNA, 17 bp, Artificial sequence
  Synthetic Oligonucleotide
acttaacaatatcatat

SEQ ID NO: 3833 - DNA, 17 bp, Artificial sequence
  Synthetic Oligonucleotide
cacttaacaatatcata

SEQ ID NO: 3834 - DNA, 17 bp, Artificial sequence
  Synthetic Oligonucleotide
agcactgaatccatagc

SEQ ID NO: 3835 - DNA, 17 bp, Artificial sequence
  Synthetic Oligonucleotide
acatttctgaatcccag

SEQ ID NO: 3836 - DNA, 17 bp, Artificial sequence
  Synthetic Oligonucleotide
ccttcagtctcaagggg

SEQ ID NO: 3837 - DNA, 17 bp, Artificial sequence
  Synthetic Oligonucleotide
atatctaaagaccgcaa

SEQ ID NO: 3838 - DNA, 17 bp, Artificial sequence
  Synthetic Oligonucleotide
aaactcatggacttcgt

SEQ ID NO: 3839 - DNA, 17 bp, Artificial sequence
  Synthetic Oligonucleotide
cattcggttataaggca

SEQ ID NO: 3840 - DNA, 17 bp, Artificial sequence
  Synthetic Oligonucleotide
accctttccatgtgaac

SEQ ID NO: 3841 - DNA, 17 bp, Artificial sequence
  Synthetic Oligonucleotide
tttcatagcttccacca

SEQ ID NO: 3842 - DNA, 17 bp, Artificial sequence
  Synthetic Oligonucleotide
catgaggacttccacat

SEQ ID NO: 3843 - DNA, 17 bp, Artificial sequence
  Synthetic Oligonucleotide
catggcatcaaaaatta

SEQ ID NO: 3844 - DNA, 17 bp, Artificial sequence
  Synthetic Oligonucleotide
cacaaactcatggactt

SEQ ID NO: 3845 - DNA, 17 bp, Artificial sequence
  Synthetic Oligonucleotide
agttccttcagtctcaa

SEQ ID NO: 3846 - DNA, 17 bp, Artificial sequence
  Synthetic Oligonucleotide
ttcggttataaggcaca

SEQ ID NO: 3847 - DNA, 17 bp, Artificial sequence
  Synthetic Oligonucleotide
atttagcttatgatgaa

SEQ ID NO: 3848 - DNA, 20 bp, Artificial sequence
  Synthetic Oligonucleotide
cctataggactatccaggaa

The invention claimed is:
1. A modified oligonucleotide according to the following chemical structure:

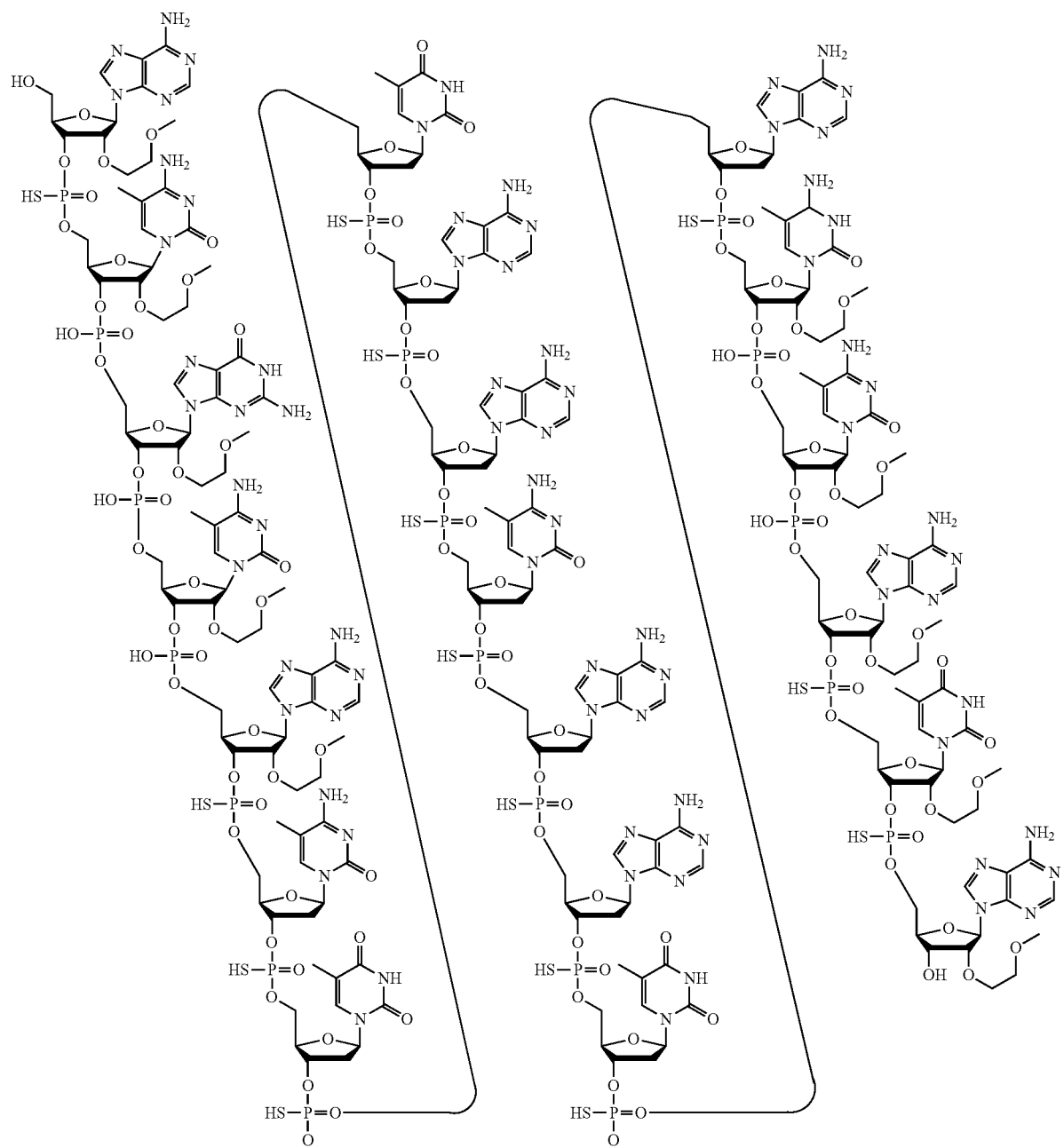

(SEQ ID NO: 3590)
or a salt thereof.

2. The modified oligonucleotide of claim 1, which is the sodium salt or the potassium salt.

3. A modified oligonucleotide according to the following chemical structure:

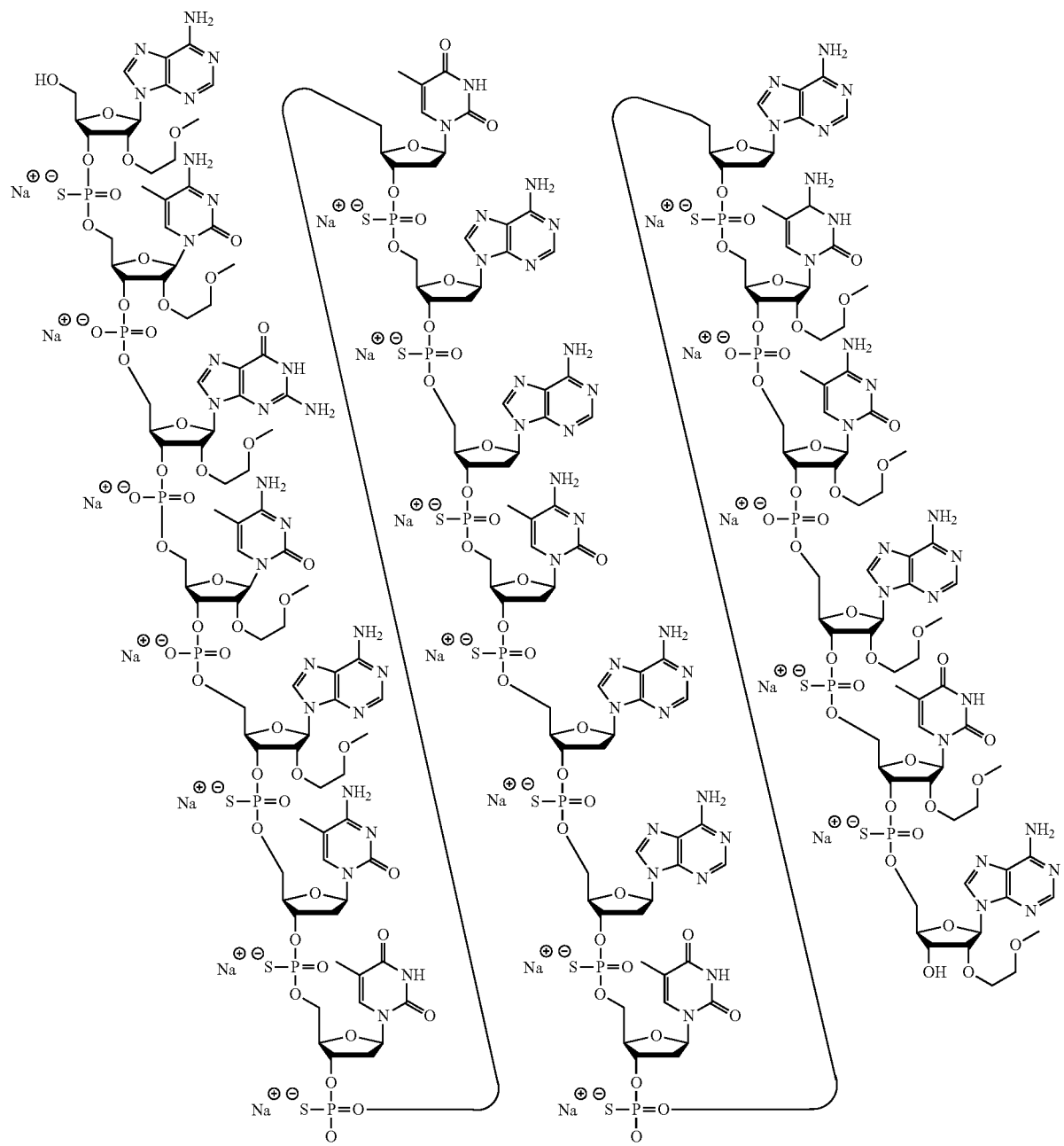

(SEQ ID NO: 3590).

4. An oligomeric compound comprising a modified oligonucleotide according to the following chemical notation:

Aes mCeo Geo mCeo Aes mCds Tds Tds Ads Ads
mCds Ads Ads Tds Ads Teo mCeo Aes Tes Ae
(SEQ ID NO: 3590); wherein, A=an adenine nucleobase,
mC=a 5-methyl cytosine nucleobase,
G=a guanine nucleobase,
T=a thymine nucleobase,
e=a 2'-OCH$_2$CH$_2$OCH$_3$ ribosyl sugar moiety,
d=a 2'-deoxyribosyl sugar moiety,
s=a phosphorothioate internucleoside linkage, and
o=a phosphodiester internucleoside linkage.

5. A population of modified oligonucleotides of claim 1, wherein all of the phosphorothioate internucleoside linkages of the modified oligonucleotides are stereorandom.

6. A pharmaceutical composition comprising a modified oligonucleotide of claim 1 and a pharmaceutically acceptable diluent.

7. The pharmaceutical composition of claim 6, wherein the pharmaceutically acceptable diluent is phosphate-buffered saline (PBS) or artificial cerebrospinal fluid.

8. The pharmaceutical composition of claim 7, wherein the pharmaceutical composition consists essentially of the modified oligonucleotide and artificial cerebrospinal fluid.

9. The pharmaceutical composition of claim 7, wherein the pharmaceutical composition consists essentially of the modified oligonucleotide and PBS.

10. A population of modified oligonucleotides of claim 3, wherein all of the phosphorothioate internucleoside linkages of the modified oligonucleotides are stereorandom.

11. A pharmaceutical composition comprising a modified oligonucleotide of claim 3 and a pharmaceutically acceptable diluent.

12. The pharmaceutical composition of claim 11, wherein the pharmaceutically acceptable diluent is phosphate-buffered saline (PBS) or artificial cerebrospinal fluid.

13. The pharmaceutical composition of claim 12, wherein the pharmaceutical composition consists essentially of the modified oligonucleotide and artificial cerebrospinal fluid.

14. The pharmaceutical composition of claim 12, wherein the pharmaceutical composition consists essentially of the modified oligonucleotide and PBS.

15. A population of oligomeric compounds of claim 4, wherein all of the phosphorothioate internucleoside linkages of the modified oligonucleotide are stereorandom.

16. A pharmaceutical composition comprising the oligomeric compound of claim 4 and a pharmaceutically acceptable diluent.

17. The pharmaceutical composition of claim 16, wherein the pharmaceutically acceptable diluent is phosphate-buffered saline (PBS) or artificial cerebrospinal fluid.

18. The pharmaceutical composition of claim 17, wherein the pharmaceutical composition consists essentially of the oligomeric compund and artificial cerebrospinal fluid.

19. The pharmaceutical composition of claim 17, wherein the pharmaceutical composition consists essentially of the oligomeric compund and PBS.

20. A method comprising administering to a subject a pharmaceutical composition of claim 6.

21. A method of treating Parkinson's disease comprising administering to a subject having or at risk for developing Parkinson's disease a therapeutically effective amount of a pharmaceutical composition according to claim 6 and thereby treating Parkinson's disease.

22. The method of claim 21, wherein at least one symptom or hallmark of Parkinson's disease is ameliorated.

23. The method of claim 22, wherein the symptom or hallmark is any of ataxia, neuropathy, and aggregate formation.

24. A method of reducing expression of LRRK2 in a cell comprising contacting the cell with a modified oligonucleotide of claim 1.

25. The method of claim 21, wherein the subject is human.

26. The method of claim 24, wherein the cell is a human cell.

\* \* \* \* \*